United States Patent 11,805,774 (SEED TREATMENT METHODS AND COMPOSITIONS FOR IMPROVING PLANT TRAITS AND YIELD) - sequence listing, part 2

SEQ ID NO: 1744 - DNA, 213 bp, Bacillus sp. GZT
  ref <308>: DATABASE ACCESSION NUMBER: NCBI ACCESSION: NZ_LVVJ01000096.1
  ref <309>: DATABASE ENTRY DATE: 2019-04-01
  ref <313>: RELEVANT RESIDUES IN SEQ ID NO: (1)..(213)
ttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtc

SEQ ID NO: 1745 - DNA, 1556 bp, Bacillus sp. GeD10; identical to SEQ ID NO: 185
  ref <308>: DATABASE ACCESSION NUMBER: NCBI ACCESSION: NZ_CAVI010000166.1
  ref <309>: DATABASE ENTRY DATE: 2019-04-01
  ref <313>: RELEVANT RESIDUES IN SEQ ID NO: (1)..(1556)

SEQ ID NO: 1746 - DNA, 1557 bp, Bacillus sp. H15-1
  ref <308>: DATABASE ACCESSION NUMBER: NCBI ACCESSION: NZ_CP018249.1
  ref <309>: DATABASE ENTRY DATE: 2019-04-01
  ref <313>: RELEVANT RESIDUES IN SEQ ID NO: (1)..(1557)
tatttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1747 - DNA, 1377 bp, Bacillus sp. HMSC036E02
  ref <308>: DATABASE ACCESSION NUMBER: NCBI ACCESSION: NZ_KV827841.1
  ref <309>: DATABASE ENTRY DATE: 2019-04-01
  ref <313>: RELEVANT RESIDUES IN SEQ ID NO: (1)..(1377)
attttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttctatgga

SEQ ID NO: 1748 - DNA, 1554 bp, Bacillus sp. HMSC76G11
  ref <308>: DATABASE ACCESSION NUMBER: NCBI ACCESSION: NZ_KV837549.1
  ref <309>: DATABASE ENTRY DATE: 2019-04-01
  ref <313>: RELEVANT RESIDUES IN SEQ ID NO: (1)..(1554)
tcttcggagagtttgatcctggctcaggacgaacgctggcggcgtgcctaatacatgcaagtcgagcggacttgctggagcttgctccagcaggttagcggcggacgggtgagtaacacgtgggcaacctgcctgtaagactgggataactccgggaaaccggagctaataccggatagtatcttgaaccgcatggttcaagttggaaagacggtttcggctgtcacttacagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgccacttctagagatagaaggttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaaccgcaaggagccagccgcctaaggtggggtagatgattggggtgaagtcgtaacaaggtagccgtatcggaaggtgcggctggatcacctcctttctaa

SEQ ID NO: 1749 - DNA, 1484 bp, Bacillus sp. I-2
  ref <308>: DATABASE ACCESSION NUMBER: NCBI ACCESSION: NZ_LZRW01000013.1
  ref <309>: DATABASE ENTRY DATE: 2019-04-01
  ref <313>: RELEVANT RESIDUES IN SEQ ID NO: (1)..(1484)
acagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1750 - DNA, 1554 bp, Bacillus sp. IHB B 7164
  ref <308>: DATABASE ACCESSION NUMBER: NCBI ACCESSION: NZ_CP015226.1
  ref <309>: DATABASE ENTRY DATE: 2019-04-01
  ref <313>: RELEVANT RESIDUES IN SEQ ID NO: (1)..(1554)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatggggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttctaa

SEQ ID NO: 1751 - DNA, 291 bp, Bacillus sp. J33
  ref <308>: DATABASE ACCESSION NUMBER: NCBI ACCESSION: NZ_JAEL01000114.1
  ref <309>: DATABASE ENTRY DATE: 2019-04-01
  ref <313>: RELEVANT RESIDUES IN SEQ ID NO: (1)..(291)
ttatatggagagtttgatcctggctcaggacgaacgctggcggcgtgcctaatacatgcaagtcgagcggacggatgggagcttgctcccagaccgtcagcggcggacgggtgagtaacacgtgggcaacctgcctgtaagactgggataactccgggaaaccggggctaataccggataattctttccctcacatgagggaaagctgaaagatggtttcggctatcacttacagatgggcccgcggcgcattagctagttggtgaggtaacggctcaccaaggcaacgat

SEQ ID NO: 1752 - DNA, 306 bp, Bacillus sp. J37
  ref <308>: DATABASE ACCESSION NUMBER: NCBI ACCESSION: NZ_JAEK01000047.1
  ref <309>: DATABASE ENTRY DATE: 2019-04-01
  ref <313>: RELEVANT RESIDUES IN SEQ ID NO: (1)..(306)
tttattggagagtttgatcctggctcaggacgaacgctggcggcgtgcctaatacatgcaagtcgagcgaatctgagggagcttgctcccaaagattagcggcggacgggtgagtaacacgtgggtaacctgcctgtaagattgggataactccgggaaaccggagctaataccggataacatttcgaaccgcatggttcgggattgaaagatggtttcggctatcacttacagatggacccgcggcgcattagctagttggtgaggtaacggctcaccaaggcaacgatgcgtagccgacctgag

SEQ ID NO: 1753 - DNA, 1556 bp, Bacillus sp. JCM 19034
  ref <308>: DATABASE ACCESSION NUMBER: NCBI ACCESSION: NZ_BAXR01000049.1
  ref <309>: DATABASE ENTRY DATE: 2019-04-01
  ref <313>: RELEVANT RESIDUES IN SEQ ID NO: (1)..(1556)
ttttatggagagtttgatcctggctcaggacgaacgctggcggcgtgcctaatacatgcaagtcgagcgaacagaataagagcttgctcttatgacgttagcggcgaacgggtgagtaacacgtgggcaacctgccctgtagactgggataacatcgagaaatcggtgctaataccggataatttctaaggtcgcatgaccatagagtaaaagatggcctttggctatcactacaggatgggcccgcggcgcattagctagttggtggggtaaaagcttaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaagggtttcggctcgtaaagctctgttgttagggaagaacaagtgctattcgaatagggtggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagatacctggtagtccacgccgtaaacgatgagtgctaggtgttaggggtttcgatgccttagtgccgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatccttatgccctccctagagatagggatttcccttcggggacataagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaagccgcgaggtgaagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1754 - DNA, 1552 bp, Bacillus sp. JCM 19045
  ref <308>: DATABASE ACCESSION NUMBER: NCBI ACCESSION: NZ_BAWA01000061.1
  ref <309>: DATABASE ENTRY DATE: 2019-04-01
  ref <313>: RELEVANT RESIDUES IN SEQ ID NO: (1)..(1552)
ttttaacggagagtttgatcctggctcaggacgaacgctggcggcatgcctaatacatgcaagtcgagcggacagaagggagcttgctcccggaagtcagcggcggacgggtgagtaacacgtgggcaacctgcccttagattgggataacttcgggaaaccgaagctaataccgaataatacaaggaacctcctggttctctgttgaaagatggcctttgtgctgtcactaaggatgggccgcggcgcattagctagttggtaaggtaacggcttaccaaggcgacgatgcgtagccgacctgagagggtgatcggccacactgggactgagacacggcccagactcctacgggaggcagcagtagggaatcttccgcaatggacgaaagtctgacggagcaatgccgcgtgagtgaggaaggccttcgggtcgtaaagctctgttgtgagggaagaacaagtaccggcgtaactaccggtaccgtgacggtacctcaccagaaagccacggctaactacgtgccagcagccgcggtaatacgtaggtggcaagcgttgtccggaattattgggcgtaaagcgcgcgcaggcggcttcttaagtctgatgtgaaatctcggggctcaaccccgagcggccattggaaactgggaagcttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccgtagtgccgaagtaaacacattaagcactccgcctggggagtacggccgcaaggctgaaactcaaaggaattgacggggacccgcacaagcagtggagcatgtggtttaattcgaagcaacgcgaagaaccttaccaggtcttgacatcctttgaccactctggagacagagcttccccttcgggggcaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggacgacgtcaaatcatcatgccccttatgacctgggctacacacgtgctacaatggatggtacaaagggttgcgaagccgtgaggtggagccaatcccataaagccattctcagttcggattgtaggctgcaactcgcctacatgaagccggaattgctagtaatcgcggatcagcatgccgcggtgaatacgttcccgggtcttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 1755 - DNA, 1556 bp, Bacillus sp. JFL15
  ref <308>: DATABASE ACCESSION NUMBER: NCBI ACCESSION: NZ_KQ236689.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1756 - DNA, 1556 bp, Bacillus sp. JH7; identical to SEQ ID NO: 120
  ref <308>: DATABASE ACCESSION NUMBER: NCBI ACCESSION: NZ_LPUS01000007.1
  ref <309>: DATABASE ENTRY DATE: 2019-04-01
  ref <313>: RELEVANT RESIDUES IN SEQ ID NO: (1)..(1556)

SEQ ID NO: 1757 - DNA, 1556 bp, Bacillus sp. JKS001846
  ref <308>: DATABASE ACCESSION NUMBER: NCBI ACCESSION: NZ_FWYG01000001.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 1758 - DNA, 1555 bp, Bacillus sp. L27
  ref <308>: DATABASE ACCESSION NUMBER: NCBI ACCESSION: NZ_MAOD01000026.1
  ref <309>: DATABASE ENTRY DATE: 2019-04-01
  ref <313>: RELEVANT RESIDUES IN SEQ ID NO: (1)..(1555)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttcta

SEQ ID NO: 1759 - DNA, 1554 bp, Bacillus sp. LK10
  ref <308>: DATABASE ACCESSION NUMBER: NCBI ACCESSION: NZ_LDUQ01000009.1
  ref <309>: DATABASE ENTRY DATE: 2019-04-01
  ref <313>: RELEVANT RESIDUES IN SEQ ID NO: (1)..(1554)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1760 - DNA, 1359 bp, Bacillus sp. LK2
  ref <308>: DATABASE ACCESSION NUMBER: NCBI ACCESSION: NZ_LDUK01000046.1
  ref <309>: DATABASE ENTRY DATE: 2019-04-01
  ref <313>: RELEVANT RESIDUES IN SEQ ID NO: (1)..(1359)
cgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttctatgga

SEQ ID NO: 1761 - DNA, 1364 bp, Bacillus sp. LK7
  ref <308>: DATABASE ACCESSION NUMBER: NCBI ACCESSION: NZ_LDUN01000015.1
  ref <309>: DATABASE ENTRY DATE: 2019-04-01
  ref <313>: RELEVANT RESIDUES IN SEQ ID NO: (1)..(1364)
gcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1762 - DNA, 1558 bp, Bacillus sp. LL01
  ref <308>: DATABASE ACCESSION NUMBER: NCBI ACCESSION: NZ_LFEL01000009.1
  ref <309>: DATABASE ENTRY DATE: 2019-04-01
  ref <313>: RELEVANT RESIDUES IN SEQ ID NO: (1)..(1558)
ctttattggagagtttgatcctggctcaggacgaacgctggcggcgtgcctaatacatgcaagtcgagcggactwcttaaaagcttgcttttaagwagtcagcggcggacgggtgagtaacacgtgggcaacctgcctgtgagactgggataacttcgggaaaccggagctaataccggataatataaggaacctcctggttctttattgaaagatggtttcggctatcacttgcagatgggcccgcggcgcattagctagttggtgaggtaatggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagcgcgcgcaggtggtcctttaagtctgatgtgaaagcccacggctcaaccgtggagggtcattggaaactgggggacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacaaagggcagcaaaaccgcgaggtcgagccaatcccataaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1763 - DNA, 1556 bp, Bacillus sp. LM 4-2
  ref <308>: DATABASE ACCESSION NUMBER: NCBI ACCESSION: NZ_CP011101.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1764 - DNA, 1426 bp, Bacillus sp. L 1B0 12
  ref <308>: DATABASE ACCESSION NUMBER: NCBI ACCESSION: NZ_LAVH01000067.1
  ref <309>: DATABASE ENTRY DATE: 2019-04-01
  ref <313>: RELEVANT RESIDUES IN SEQ ID NO: (1)..(1426)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttg

SEQ ID NO: 1765 - DNA, 1556 bp, Bacillus sp. L 1B0 5; identical to SEQ ID NO: 207
  ref <308>: DATABASE ACCESSION NUMBER: NCBI ACCESSION: NZ_JXIS01000061.1
  ref <309>: DATABASE ENTRY DATE: 2019-04-01
  ref <313>: RELEVANT RESIDUES IN SEQ ID NO: (1)..(1556)

SEQ ID NO: 1766 - DNA, 1556 bp, Bacillus sp. L 1B0 8; identical to SEQ ID NO: 207
  ref <308>: DATABASE ACCESSION NUMBER: NCBI ACCESSION: NZ_JXIT01000050.1
  ref <309>: DATABASE ENTRY DATE: 2019-04-01
  ref <313>: RELEVANT RESIDUES IN SEQ ID NO: (1)..(1556)

SEQ ID NO: 1767 - DNA, 1537 bp, Bacillus sp. Leaf13
  ref <308>: DATABASE ACCESSION NUMBER: NCBI ACCESSION: NZ_LMRJ01000012.1
  ref <309>: DATABASE ENTRY DATE: 2019-04-01
  ref <313>: RELEVANT RESIDUES IN SEQ ID NO: (1)..(1537)
tcggagagtttgatcctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggcctctagctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcgggggg

SEQ ID NO: 1768 - DNA, 1555 bp, Bacillus sp. Leaf406
  ref <308>: DATABASE ACCESSION NUMBER: NCBI ACCESSION: NZ_LMRU01000001.1
  ref <309>: DATABASE ENTRY DATE: 2019-04-01
  ref <313>: RELEVANT RESIDUES IN SEQ ID NO: (1)..(1555)
tttatggagagtttgatcctggctcaggacgaacgctggcggcgtgcctaatacatgcaagtcgagcggatcgatgggagcttgctccctgagatcagcggcggacgggtgagtaacacgtgggtaacctgcctgtaagactgggataactccgggaaaccggggctaataccggataacacctacccccgcatgggggaaggttgaaaggtggcttcggctatcacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtgccgttcgaatagggcggcgccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggctgcaagaccgcgaggtttagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 1769 - DNA, 1550 bp, Bacillus sp. Leaf49
  ref <308>: DATABASE ACCESSION NUMBER: NCBI ACCESSION: NZ_LMRK01000001.1
  ref <309>: DATABASE ENTRY DATE: 2019-04-01
  ref <313>: RELEVANT RESIDUES IN SEQ ID NO: (1)..(1550)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttcyttgaaccgcatgsttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattyagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1770 - DNA, 1553 bp, Bacillus sp. Leaf75
  ref <308>: DATABASE ACCESSION NUMBER: NCBI ACCESSION: NZ_LMRL01000034.1
  ref <309>: DATABASE ENTRY DATE: 2019-04-01
  ref <313>: RELEVANT RESIDUES IN SEQ ID NO: (1)..(1553)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacragagtaactgctygtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcattyagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttctaa

SEQ ID NO: 1771 - DNA, 542 bp, Bacillus sp. MB2021
  ref <308>: DATABASE ACCESSION NUMBER: NCBI ACCESSION: NZ_JNJJ01000101.1
  ref <309>: DATABASE ENTRY DATE: 2019-04-01
  ref <313>: RELEVANT RESIDUES IN SEQ ID NO: (1)..(542)
tttattggagagtttgatcctggctcaggacgaacgctggcggcgtgcctaatacatgcaagtcgagcggactttaaaagcttgcttttaaagttagcggcggacgggtgagtaacacgtgggcaacctgcctgtaagactgggataacttcgggaaaccggagctaataccggataatccttttctactcatgtagaaaagctgaaagacggcatttcgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatac

SEQ ID NO: 1772 - DNA, 1459 bp, Bacillus sp. MB366
  ref <308>: DATABASE ACCESSION NUMBER: NCBI ACCESSION: NZ_MRWR01000168.1
  ref <309>: DATABASE ENTRY DATE: 2019-04-01
  ref <313>: RELEVANT RESIDUES IN SEQ ID NO: (1)..(1459)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacc

SEQ ID NO: 1773 - DNA, 1336 bp, Bacillus sp. MKU004
  ref <308>: DATABASE ACCESSION NUMBER: NCBI ACCESSION: NZ_LXUH01000089.1
  ref <309>: DATABASE ENTRY DATE: 2019-04-01
  ref <313>: RELEVANT RESIDUES IN SEQ ID NO: (1)..(1336)
gctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtgccgttcgaatagggcggcaccttgacggtacctaaccagaaagccacggctaactacgtgccagcagccgcggtaatacgtaggtggcaagcgttgtccggaattattgggcgtaaagcgcgcgcaggtggtttcttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggcagcgagaccgcgaggtttagccaatcccataaaaccgttctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 1774 - DNA, 1352 bp, Bacillus sp. MRMR6
  ref <308>: DATABASE ACCESSION NUMBER: NCBI ACCESSION: NZ_MSLS01000075.1
  ref <309>: DATABASE ENTRY DATE: 2019-04-01
  ref <313>: RELEVANT RESIDUES IN SEQ ID NO: (1)..(1352)
gggtgagtaacacgtgggcaacctgcctgtaagactgggataacatcgggaaaccgatgctaataccggataatccttttcctctcatgagggaaagctgaaagtcggcttctcgctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgatgaaggccttcgggtcgtaaagttctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttaagcgaatcccataaaaccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtggggtaacc

SEQ ID NO: 1775 - DNA, 1554 bp, Bacillus sp. MSP13
  ref <308>: DATABASE ACCESSION NUMBER: NCBI ACCESSION: NZ_JXAQ01000021.1
  ref <309>: DATABASE ENTRY DATE: 2019-04-01
  ref <313>: RELEVANT RESIDUES IN SEQ ID NO: (1)..(1554)
tttatggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1776 - DNA, 1549 bp, Bacillus sp. MSP5.4
  ref <308>: DATABASE ACCESSION NUMBER: NCBI ACCESSION: NZ_JXAP01000015.1
  ref <309>: DATABASE ENTRY DATE: 2019-04-01
  ref <313>: RELEVANT RESIDUES IN SEQ ID NO: (1)..(1549)
ggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgattgaaccgcatggttcaattataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1777 - DNA, 1381 bp, Bacillus sp. MUM 116
  ref <308>: DATABASE ACCESSION NUMBER: NCBI ACCESSION: NZ_MLYR01000103.1
  ref <309>: DATABASE ENTRY DATE: 2019-04-01
  ref <313>: RELEVANT RESIDUES IN SEQ ID NO: (1)..(1381)
ggttaatccttttccacacatgtgggaaagctgaaagtcggtttcggctgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatcggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggactttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaaggtgggacagatgattggggtgaagtcgtaacaaggtagccgtatcggaaggtgcggctggatcacctcctttctaa

SEQ ID NO: 1778 - DNA, 1552 bp, Bacillus sp. MUM 13; identical to SEQ ID NO: 312
  ref <308>: DATABASE ACCESSION NUMBER: NCBI ACCESSION: NZ_MLYQ01000055.1
  ref <309>: DATABASE ENTRY DATE: 2019-04-01
  ref <313>: RELEVANT RESIDUES IN SEQ ID NO: (1)..(1552)

SEQ ID NO: 1779 - DNA, 1281 bp, Bacillus sp. M 2-6
  ref <308>: DATABASE ACCESSION NUMBER: NCBI ACCESSION: NZ_AJWW01000044.1
  ref <309>: DATABASE ENTRY DATE: 2019-04-01
  ref <313>: RELEVANT RESIDUES IN SEQ ID NO: (1)..(1281)
ctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1780 - DNA, 1556 bp, Bacillus sp. N35-10-4; identical to SEQ ID NO: 400
  ref <308>: DATABASE ACCESSION NUMBER: NCBI ACCESSION: NZ_MAOF01000060.1
  ref <309>: DATABASE ENTRY DATE: 2019-04-01
  ref <313>: RELEVANT RESIDUES IN SEQ ID NO: (1)..(1556)

SEQ ID NO: 1781 - DNA, 1556 bp, Bacillus sp. NH11B; identical to SEQ ID NO: 146
  ref <308>: DATABASE ACCESSION NUMBER: NCBI ACCESSION: NZ_MAOG01000079.1
  ref <309>: DATABASE ENTRY DATE: 2019-04-01
  ref <313>: RELEVANT RESIDUES IN SEQ ID NO: (1)..(1556)

SEQ ID NO: 1782 - DNA, 1331 bp, Bacillus sp. NSP2.1
  ref <308>: DATABASE ACCESSION NUMBER: NCBI ACCESSION: NZ_KI301987.1
  ref <309>: DATABASE ENTRY DATE: 2019-04-01
  ref <313>: RELEVANT RESIDUES IN SEQ ID NO: (1)..(1331)
ctatcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgtcagggacgaacacgtaccgttcgaacagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgagaggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 1783 - DNA, 1546 bp, Bacillus sp. NSP9.1
  ref <308>: DATABASE ACCESSION NUMBER: NCBI ACCESSION: NZ_KE819968.1
  ref <309>: DATABASE ENTRY DATE: 2019-04-01
  ref <313>: RELEVANT RESIDUES IN SEQ ID NO: (1)..(1546)
agagtttgatcctggctcaggacgaacgctggcggcgtgcctaatacatgcaagtcgagcggaccgatgggagcttgctccctgaggttagcggcggacgggtgagtaacacgtgggtaacctgcctgtaagactgggataactccgggaaaccggggctaataccggatgcttgattgaaccgcatggttcaatcataaaagatggcttcggctatcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacacccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1784 - DNA, 1556 bp, Bacillus sp. OxB-1
  ref <308>: DATABASE ACCESSION NUMBER: NCBI ACCESSION: NZ_AP013294.1
  ref <309>: DATABASE ENTRY DATE: 2019-04-01
  ref <313>: RELEVANT RESIDUES IN SEQ ID NO: (1)..(1556)
attatggagagtttgatcctggctcaggacgaacgctggcggcgtgcctaatacatgcaagtcgagcggacggatgggagcttgctccctgaagttagcggcggacgggtgagtaacacgtgggcaacctgccctgcagatggggataactccgggaaaccggggctaataccgaataatcagttcctccgcatggaggaattctgaaagacggtttcggctgtcactgcaggatgggcccgcggcgcattagctagttggtggggtaacggcctaccaaggcgacgatgcgtagccgacctgagagggtgatcggccacactgggactgagacacggcccagactcctacgggaggcagcagtagggaatcttccacaatggacggaagtctgatggagcaacgccgcgtgagcgaagaaggttttcggatcgtaaagctctgttgtaagggaagaacacgtacgggagtcactgcccgtaccttgacggtaccttatcagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacggggacccgcacaagcggtggagcatgtggtttaattcgaagcaacgcgaagaaccttaccaggtcttgacatcccgctgcccggcatggagacatgcctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacagagggctgcgaacccgcgagggggagccaatcccataaaaccgttcccagttcggattgcaggctgcaactcgcctgcatgaagccggaatcgctagtaatcgtggatcagcatgccacggtgaatacgttcccgggtcttgtacacaccgcccgtcacaccacgagagtttgtaacacccgaagtcggtggggtaacccttacgggagccagccgccgaaggtgggacagatgattggggtgaagtcgtaacaaggtagccgtatcggaaggtgcggctggatcacctcctttctaa

SEQ ID NO: 1785 - DNA, 1007 bp, Bacillus sp. P14-1
  ref <308>: DATABASE ACCESSION NUMBER: NCBI ACCESSION: NZ_MAOH01000060.1
  ref <309>: DATABASE ENTRY DATE: 2019-04-01
  ref <313>: RELEVANT RESIDUES IN SEQ ID NO: (1)..(1007)
ggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctatgga

SEQ ID NO: 1786 - DNA, 1555 bp, Bacillus sp. Pc3
  ref <308>: DATABASE ACCESSION NUMBER: NCBI ACCESSION: NZ_CP010406.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1787 - DNA, 1461 bp, Bacillus sp. REN51N
  ref <308>: DATABASE ACCESSION NUMBER: NCBI ACCESSION: NZ_JXAB01000016.1
  ref <309>: DATABASE ENTRY DATE: 2019-04-01
  ref <313>: RELEVANT RESIDUES IN SEQ ID NO: (1)..(1461)
cttagcggcggacgggtgagtaacacgtgggcaacctgcccttgagacggggataactccgggaaaccggagctaataccggataacacatatcttcgcatgaggatatgttagaaggtggcttttagctaccactcaaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtatctgttgaataagcaggtaccttgacggtacctaaccagaaagccacggctaactacgtgccagcagccgcggtaatacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacggggacccgcacaagcggtggagcatgtggtttaattcgaagcaacgcgaagaaccttaccaggtcttgacatcctctgctacttctagagatagaaggttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgtgaggtcgagccaatcccataaaaccattctcagttcggattgtaggctgcaactcgcctacatgaagccggaatcgctagtaatcgcggatcagcatgccgcggtgaatacgttcccgggtcttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1788 - DNA, 1554 bp, Bacillus sp. RRD69
  ref <308>: DATABASE ACCESSION NUMBER: NCBI ACCESSION: NZ_FTPN01000004.1
  ref <309>: DATABASE ENTRY DATE: 2019-04-01
  ref <313>: RELEVANT RESIDUES IN SEQ ID NO: (1)..(1554)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggttgcgagactgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1789 - DNA, 1553 bp, Bacillus sp. RU2C
  ref <308>: DATABASE ACCESSION NUMBER: NCBI ACCESSION: NZ_FTML01000040.1
  ref <309>: DATABASE ENTRY DATE: 2019-04-01
  ref <313>: RELEVANT RESIDUES IN SEQ ID NO: (1)..(1553)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataagagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 1790 - DNA, 1555 bp, Bacillus sp. RUPDJ
  ref <308>: DATABASE ACCESSION NUMBER: NCBI ACCESSION: NZ_FTNS01000016.1
  ref <309>: DATABASE ENTRY DATE: 2019-04-01
  ref <313>: RELEVANT RESIDUES IN SEQ ID NO: (1)..(1555)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1791 - DNA, 1556 bp, Bacillus sp. RUTrin4; identical to SEQ ID NO: 268
  ref <308>: DATABASE ACCESSION NUMBER: NCBI ACCESSION: NZ_FVZK01000015.1
  ref <309>: DATABASE ENTRY DATE: 2019-04-01
  ref <313>: RELEVANT RESIDUES IN SEQ ID NO: (1)..(1556)

SEQ ID NO: 1792 - DNA, 1367 bp, Bacillus sp. RZ2MS9; identical to SEQ ID NO: 374
  ref <308>: DATABASE ACCESSION NUMBER: NCBI ACCESSION: NZ_MJBF01000014.1
  ref <309>: DATABASE ENTRY DATE: 2019-04-01
  ref <313>: RELEVANT RESIDUES IN SEQ ID NO: (1)..(1367)

SEQ ID NO: 1793 - DNA, 1556 bp, Bacillus sp. Root11; identical to SEQ ID NO: 182
  ref <308>: DATABASE ACCESSION NUMBER: NCBI ACCESSION: NZ_LMJP01000051.1
  ref <309>: DATABASE ENTRY DATE: 2019-04-01
  ref <313>: RELEVANT RESIDUES IN SEQ ID NO: (1)..(1556)

SEQ ID NO: 1794 - DNA, 1556 bp, Bacillus sp. Root131; identical to SEQ ID NO: 182
  ref <308>: DATABASE ACCESSION NUMBER: NCBI ACCESSION: NZ_LMJQ01000012.1
  ref <309>: DATABASE ENTRY DATE: 2019-04-01
  ref <313>: RELEVANT RESIDUES IN SEQ ID NO: (1)..(1556)

SEQ ID NO: 1795 - DNA, 1553 bp, Bacillus sp. Root147
  ref <308>: DATABASE ACCESSION NUMBER: NCBI ACCESSION: NZ_LMJR01000021.1
  ref <309>: DATABASE ENTRY DATE: 2019-04-01
  ref <313>: RELEVANT RESIDUES IN SEQ ID NO: (1)..(1553)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacragagtaactgctygtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcragaccgcgaggtyaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttctaa

SEQ ID NO: 1796 - DNA, 1634 bp, Bacillus sp. Root239
  ref <308>: DATABASE ACCESSION NUMBER: NCBI ACCESSION: NZ_LMJS01000042.1
  ref <309>: DATABASE ENTRY DATE: 2019-04-01
  ref <313>: RELEVANT RESIDUES IN SEQ ID NO: (1)..(1634)
tcggagagtttgatcctggctcaggatgaacgctggcggcgtgcctaatacatgcaagtcgagcgaactgattagatttcttcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgctygtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaggtgggacagatgattggggtgaagtcgtaacaaggtagccgtatcggaaggtgcggctggatcacctcctttctaa

SEQ ID NO: 1797 - DNA, 1550 bp, Bacillus sp. Root920
  ref <308>: DATABASE ACCESSION NUMBER: NCBI ACCESSION: NZ_LMJV01000001.1
  ref <309>: DATABASE ENTRY DATE: 2019-04-01
  ref <313>: RELEVANT RESIDUES IN SEQ ID NO: (1)..(1550)
tcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattyagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1798 - DNA, 1556 bp, Bacillus sp. S1-R1J2-FB; identical to SEQ ID NO: 204
  ref <308>: DATABASE ACCESSION NUMBER: NCBI ACCESSION: NZ_NBNV01000035.1
  ref <309>: DATABASE ENTRY DATE: 2019-04-01
  ref <313>: RELEVANT RESIDUES IN SEQ ID NO: (1)..(1556)

SEQ ID NO: 1799 - DNA, 716 bp, Bacillus sp. SA1-12
  ref <308>: DATABASE ACCESSION NUMBER: NCBI ACCESSION: NZ_LATZ01000131.1
  ref <309>: DATABASE ENTRY DATE: 2019-04-01
  ref <313>: RELEVANT RESIDUES IN SEQ ID NO: (1)..(716)
tttattggagagtttgatcctggctcaggacgaacgctggcggcgtgcctaatacatgcaagtcgagcgaatctgagggagcttgctcctgaagattagcggcggacgggtgagtaacacgtgggtaacctgcctgtaagattgggataactccgggaaaccggagctaataccggataatatttcgaaccgcatggttcgaagttgaaaggtggcttttgctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgttagggaagaacaagtaccgttcgaatagggcggtaccttgacggtacctaaccagaaagccacggctgcccacggctcaaccgtggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacg

SEQ ID NO: 1800 - DNA, 1548 bp, Bacillus sp. SB47
  ref <308>: DATABASE ACCESSION NUMBER: NCBI ACCESSION: NZ_KE819963.1
  ref <309>: DATABASE ENTRY DATE: 2019-04-01
  ref <313>: RELEVANT RESIDUES IN SEQ ID NO: (1)..(1548)
ggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatgcttgattgaaccgcatggttcaattataaaaggtggctttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1801 - DNA, 1556 bp, Bacillus sp. SDLI1
  ref <308>: DATABASE ACCESSION NUMBER: NCBI ACCESSION: NZ_CP013950.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaa

SEQ ID NO: 1802 - DNA, 1602 bp, Bacillus sp. SG-1
  ref <308>: DATABASE ACCESSION NUMBER: NCBI ACCESSION: NZ_ABCF01000001.1
  ref <309>: DATABASE ENTRY DATE: 2019-04-01
  ref <313>: RELEVANT RESIDUES IN SEQ ID NO: (1)..(1602)
tcggagagtttgatcctggctcaggacgaacgctggcggcgtgcctaatacatgcaagtcgagcggactgatgggagcttgctccctgatgtcagcggcggacgggtgagtaacacgtgggtaacctgcctgtaagactgggataactccgggaaaccggggctaataccggatagttcttttcctcgcatgaggaagagtggaaaggtggcttttagctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagcgcgcgcaggcggtctcttaagtctgatgtgaaagcccacggctcaaccgtggagggtcattggaaactgggggacttgagtacagaagaggaaagtggaattccacgtgtagcggtgaaatgcgtagatatgtggaggaacaccagtggcgaaggcgactttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattaggttgggcactctaagatgactgccggtgacaaaccggaggaaggtggggatgacgtcaaatcatcatgccccttatgacctgggctacacacgtgctacaatggacggtacaaagggcagcaagaccgcgaggtttagcaaatcccataaaaccgttctcagttcggattgcaggctgcaactcgcctgcatgaagctggaatcgctagtaatcgcggatcagcatgccgcggtgaatacgttcccgggccttgtacacaccgcccgtcacaccacgagagtttgtaacacccgaagtcggtgaggtaacctggggcaaaacttaacctcttatagtatctataggaagttaagttttgccctaggagccagccgcctaaggtgggacagatgattggggtgaagtcgtaacaaggtagccgtatcggaaggtgcggctggatcacctcctttctaa

SEQ ID NO: 1803 - DNA, 281 bp, Bacillus sp. SGD-V-76; identical to SEQ ID NO: 383
  ref <308>: DATABASE ACCESSION NUMBER: NCBI ACCESSION: NZ_KQ758712.1
  ref <309>: DATABASE ENTRY DATE: 2019-04-01
  ref <313>: RELEVANT RESIDUES IN SEQ ID NO: (1)..(281)

SEQ ID NO: 1804 - DNA, 1544 bp, Bacillus sp. SJS
  ref <308>: DATABASE ACCESSION NUMBER: NCBI ACCESSION: NZ_JAQV02000010.1
  ref <309>: DATABASE ENTRY DATE: 2019-04-01
  ref <313>: RELEVANT RESIDUES IN SEQ ID NO: (1)..(1544)
ctttttggagagtttgatcctggctcaggacgaacgctggcggcgtgcctaatacatgcaagtcgagcggacctcttcggaggtcagcggcggacgggtgagtaacacgtgggcaacctgcctgtaagactgggataactccgggaaaccggagctaataccggataacttttcgaaccgcatggttcggagataaaagacggttatgctgtcacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgggagtcactgcccgcgccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgccacttctagagatagaaggttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaaaccgcgaggttaagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccgtaagggagccagccgcctaaggtggggcagatgattggggtgaagtcgtaacaaggtagccgtatcggaaggtgcggctggatcacctcctttctaa

SEQ ID NO: 1805 - DNA, 446 bp, Bacillus sp. SM1
  misc_feature (439)..(439): n is a, c, g, or t
  ref <308>: DATABASE ACCESSION NUMBER: NCBI ACCESSION: NZ_LXJX01000002.1
  ref <309>: DATABASE ENTRY DATE: 2019-04-01
  ref <313>: RELEVANT RESIDUES IN SEQ ID NO: (1)..(446)
ccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtancgtttag

SEQ ID NO: 1806 - DNA, 1552 bp, Bacillus sp. Soil745
  ref <308>: DATABASE ACCESSION NUMBER: NCBI ACCESSION: NZ_LMSZ01000001.1
  ref <309>: DATABASE ENTRY DATE: 2019-04-01
  ref <313>: RELEVANT RESIDUES IN SEQ ID NO: (1)..(1552)
tcggagagtttgatcctggctcaggacgaacgctggcggcgtgcctaatacatgcaagtcgagcgaatcgaygggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttcyccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacytgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctttctaa

SEQ ID NO: 1807 - DNA, 1336 bp, Bacillus sp. Soil768D1
  ref <308>: DATABASE ACCESSION NUMBER: NCBI ACCESSION: NZ_LMTA01000001.1
  ref <309>: DATABASE ENTRY DATE: 2019-04-01
  ref <313>: RELEVANT RESIDUES IN SEQ ID NO: (1)..(1336)
gctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccttgatcttagttgccagcattmagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcggctggatcacctcctttctaa

SEQ ID NO: 1808 - DNA, 1554 bp, Bacillus sp. TH007
  ref <308>: DATABASE ACCESSION NUMBER: NCBI ACCESSION: NZ_LNDH01000002.1
  ref <309>: DATABASE ENTRY DATE: 2019-04-01
  ref <313>: RELEVANT RESIDUES IN SEQ ID NO: (1)..(1554)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1809 - DNA, 1555 bp, Bacillus sp. TH008
  ref <308>: DATABASE ACCESSION NUMBER: NCBI ACCESSION: NZ_JZBT01000080.1
  ref <309>: DATABASE ENTRY DATE: 2019-04-01
  ref <313>: RELEVANT RESIDUES IN SEQ ID NO: (1)..(1555)
ttttatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgtttgaaccgcatggttcaaacataaaaggtggcttttcgctaccacttacagatggacccgcggcgcattagctagttggtggggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaacagggcggtaccttgacggtacctaaccagaaagccacggctaactacgtgccagcagccgcggtaatacgtaggtggcaagcgttgtccggaattattgggcgtaaagcgcgcgcaggcggttctttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaa

SEQ ID NO: 1810 - DNA, 1555 bp, Bacillus sp. TS-2
  ref <308>: DATABASE ACCESSION NUMBER: NCBI ACCESSION: NZ_BAWL01000055.1
  ref <309>: DATABASE ENTRY DATE: 2019-04-01
  ref <313>: RELEVANT RESIDUES IN SEQ ID NO: (1)..(1555)
tttaacggagagtttgatcctggctcaggacgaacgctggcggcgtgcctaatacatgcaagtcgagcggacagaagggagcttgctcctggaagtcagcggcggacgggtgagtaacacgtgggcaacctgccctgtagactgggataacatcgagaaatcggtgctaataccggataatcgaagaaaccgcatggtttctttgtaaaagatggctccggctatcactacgggatgggcccgcggcgcattagctagttggtggggtagaggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccattcaaatagggtggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagatcggggctcaaccccgagaggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 1811 - DNA, 1556 bp, Bacillus sp. UMTAT18
  ref <308>: DATABASE ACCESSION NUMBER: NCBI ACCESSION: NZ_JSFD01000048.1
  ref <309>: DATABASE ENTRY DATE: 2019-04-01
  ref <313>: RELEVANT RESIDUES IN SEQ ID NO: (1)..(1556)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttttggagccagccgcctaaggtgggacagatgattggggtgaagtcgtaacaaggtagccgtatcggaaggtgcggctggatcacctcctttcta

SEQ ID NO: 1812 - DNA, 284 bp, Bacillus sp. UNC125MFCrub1.1
  ref <308>: DATABASE ACCESSION NUMBER: NCBI ACCESSION: NZ_JNIG01000009.1
  ref <309>: DATABASE ENTRY DATE: 2019-04-01
  ref <313>: RELEVANT RESIDUES IN SEQ ID NO: (1)..(284)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggc

SEQ ID NO: 1813 - DNA, 245 bp, Bacillus sp. UNC322MFChir4.1
  ref <308>: DATABASE ACCESSION NUMBER: NCBI ACCESSION: NZ_JQKQ01000056.1
  ref <309>: DATABASE ENTRY DATE: 2019-04-01
  ref <313>: RELEVANT RESIDUES IN SEQ ID NO: (1)..(245)
tttattggagagtttgatcctggctcaggatgaacgctggcggcgtgcctaatacatgcaagtcgagcgaacttcttaagagcttgctcttaagaagttagcggcggacgggtgagtaacacgtgggtaacctgcctataagactgggataactccgggaaaccggggctaataccggataacattttgcaccgcatggtgcgaaattgaaaggcggcttcggctgtcacttatagatggacctg

SEQ ID NO: 1814 - DNA, 452 bp, Bacillus sp. UNC41MFS5
  ref <308>: DATABASE ACCESSION NUMBER: NCBI ACCESSION: NZ_JMLP01000015.1
  ref <309>: DATABASE ENTRY DATE: 2019-04-01
  ref <313>: RELEVANT RESIDUES IN SEQ ID NO: (1)..(452)
ttcttggagagtttgatcctggctcaggacgaacgctggcggcgtgcctaatacatgcaagtcgagcgagactcttcggagtctagcggcggacgggtgagtaacacgtgggcaacctgcctgtaagactgggataacaccgggaaaccggtgctaataccggataatccttttcttctcatgagggaaagctgaaagtcggtgcaaactgacacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagta

SEQ ID NO: 1815 - DNA, 1097 bp, Bacillus sp. UNC437CL72CviS29
  ref <308>: DATABASE ACCESSION NUMBER: NCBI ACCESSION: NZ_AXVB01000049.1
  ref <309>: DATABASE ENTRY DATE: 2019-04-01
  ref <313>: RELEVANT RESIDUES IN SEQ ID NO: (1)..(1097)
aagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctatgga

SEQ ID NO: 1816 - DNA, 277 bp, Bacillus sp. UNC438CL73TsuS30
  ref <308>: DATABASE ACCESSION NUMBER: NCBI ACCESSION: NZ_AXVA01000014.1
  ref <309>: DATABASE ENTRY DATE: 2019-04-01
  ref <313>: RELEVANT RESIDUES IN SEQ ID NO: (1)..(277)
tttcttggagagtttgatcctggctcaggacgaacgctggcggcgtgcctaatacatgcaagtcgagcgaatcaataggagcttgctcctgttgattagcggcggacgggtgagtaacacgtgggcaacctgcctgtaagactgggataacttcgggaaaccggagctaataccggataatccttttcctctcatgaggaaaagctgaaagtcggtttcggctgacacttacagatgggcccgcggcgcattagctagttggtgaggtaacggctca

SEQ ID NO: 1817 - DNA, 261 bp, Bacillus sp. UNC69MF
  ref <308>: DATABASE ACCESSION NUMBER: NCBI ACCESSION: NZ_JQKM01000008.1
  ref <309>: DATABASE ENTRY DATE: 2019-04-01
  ref <313>: RELEVANT RESIDUES IN SEQ ID NO: (1)..(261)
tttatcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttg

SEQ ID NO: 1818 - DNA, 224 bp, Bacillus sp. URHB0009
  ref <308>: DATABASE ACCESSION NUMBER: NCBI ACCESSION: NZ_AUER01000011.1
  ref <309>: DATABASE ENTRY DATE: 2019-04-01
  ref <313>: RELEVANT RESIDUES IN SEQ ID NO: (1)..(224)
tttatcggagagtttgatcctggctcaggacgaacgctggcggcgtgcctaatacatgcaagtcgagcggaccacttcggtggtcagcggcggacgggtgagtaacacgtgggcaacctgcctgtaagactgggataacaccgggaaaccggtgctaataccggataatcctttccttcacatgaaggaaagctgaaagacggtttcggctgtcacttacagat

SEQ ID NO: 1819 - DNA, 1271 bp, Bacillus sp. V-88; identical to SEQ ID NO: 236
  ref <308>: DATABASE ACCESSION NUMBER: NCBI ACCESSION: NZ_FVZH01000049.1
  ref <309>: DATABASE ENTRY DATE: 2019-04-01
  ref <313>: RELEVANT RESIDUES IN SEQ ID NO: (1)..(1271)

SEQ ID NO: 1820 - DNA, 1550 bp, Bacillus sp. VT-16-64
  ref <308>: DATABASE ACCESSION NUMBER: NCBI ACCESSION: NZ_MSRF01000055.1
  ref <309>: DATABASE ENTRY DATE: 2019-04-01
  ref <313>: RELEVANT RESIDUES IN SEQ ID NO: (1)..(1550)
tgagagtttgatcctggctcaggacgaacgctggcggcgtgcctaatacatgcaagtcgagcggacaaaagaggagcttgctcctttttagtcagcggcggacgggtgagtaacacgtgggcaacctgcctgtaagactgggataactccgggaaaccggggctaataccggataatttctttttccgcatggagaaaggataaaagacggctctgctgtcacttacagatgggcccgcggcgcattagctagttggtggggtaacggcctaccaaggcaacgatgcgtagccgacctgagagggtgatcggccacactgggactgagacacggcccagactcctacgggaggcagcagtagggaatcttccgcaatggacgcaagtctgacggagcaacgccgcgtgagtgatgaaggtcttcggatcgtaaaactctgttatcagggaagaacccgcaccggagtaactgccggtgcgttgacggtacctgaccagaaagccacggctaactacgtgccagcagccgcggtaatacgtaggtggcaagcgttgtccggaattattgggcgtaaagcgcgcgcaggcggcttcttaagtctgatgtgaaagcccacggctcaaccgtggagggtcattggaaactgggaggcttgagtgcagaagaggagagcggaattccacgtgtagcggtgaaatgcgtagagatgtggaggaacaccagtggcgaaggcggctctctggtctgtaactgacgctgaggcgcgaaagcgtgggtagcgaacaggattagataccctggtagtccacgccgtaaacgatgagtgctaagtgttagggggtttccgccccttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgatgcccgctttagagataaagttttcccttcggggacatcggtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggccgcgagaccgcgaggtggagcgaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccatttggagccagccgccgaaggtgggacagatgattggggtgaagtcgtaacaaggtagccgtatcggaaggtgcggctggatcacctcctttctaa

SEQ ID NO: 1821 - DNA, 1028 bp, Bacillus sp. VT 712
  ref <308>: DATABASE ACCESSION NUMBER: NCBI ACCESSION: NZ_LWBK01000016.1
  ref <309>: DATABASE ENTRY DATE: 2019-04-01
  ref <313>: RELEVANT RESIDUES IN SEQ ID NO: (1)..(1028)
tcggagagtttgatcctggctcaggatgaacgctggcggcgtgcctaatacatgcaagtcgagcgaactgattagaagcttgcttctatgacgttagcggcggacgggtgagtaacacgtgggcaacctgcctgtaagactgggataactccgggaaaccggagctaataccggataacattttctcttgcataggagaaaattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacaagagtaactgcttgtaccttgacggtacctaaccagaaagccacggctaactacgtgccagcagccgcggtaatacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaactctagagatagagc

SEQ ID NO: 1822 - DNA, 1554 bp, Bacillus sp. WP8
  ref <308>: DATABASE ACCESSION NUMBER: NCBI ACCESSION: NZ_CP010075.1
  ref <309>: DATABASE ENTRY DATE: 2019-04-01
  ref <313>: RELEVANT RESIDUES IN SEQ ID NO: (1)..(1554)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1823 - DNA, 1558 bp, Bacillus sp. X1 2014
  ref <308>: DATABASE ACCESSION NUMBER: NCBI ACCESSION: NZ_CP008855.1
  ref <309>: DATABASE ENTRY DATE: 2019-04-01
  ref <313>: RELEVANT RESIDUES IN SEQ ID NO: (1)..(1558)
ctttattggagagtttgatcctggctcaggacgaacgctggcggcgtgcctaatacatgcaagtcgagcggaccgataggagcttgctcctgttggttagcggcggacgggtgagtaacacgtgggcaacctgcctgtaagactgggataacttcgggaaaccggagctaataccggataattcatccccttgcatgaggggatgctgaaagtcggttcacgctgacacttacagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagcgatgaaggccttcgggtcgtaaagctctgttgttagggaagaacaagtaccggagtaactgccggtaccttgacggtacctaaccagaaagccacggctaactacgtgccagcagccgcggtaatacgtaggtggcaagcgttgtccggaattattgggcgtaaagcgcgcgcaggcggtcctttaagtctggtgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttacgacctccctagagatagggatttccccttcgggggacggaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtcgagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaacctttatggagccagccgcctaaggtgggacagatgattggggtgaagtcgtaacaaggtagccgtatcggaaggtgcggctggatcacctcctttcta

SEQ ID NO: 1824 - DNA, 1556 bp, Bacillus sp. YP1
  ref <308>: DATABASE ACCESSION NUMBER: NCBI ACCESSION: NZ_CP010014.1
  ref <309>: DATABASE ENTRY DATE: 2019-04-01
  ref <313>: RELEVANT RESIDUES IN SEQ ID NO: (1)..(1556)
atttatcggagagtttgatcctggctcaggacgaacgctggcggcgtgcctaatacatgcaagtcgagcggacagatgggagcttgctccctgatgttagcggcggacgggtgagtaacacgtgggtaacctacctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1825 - DNA, 265 bp, Bacillus sp. bc15
  ref <308>: DATABASE ACCESSION NUMBER: NCBI ACCESSION: NZ_FRBJ01000017.1
  ref <309>: DATABASE ENTRY DATE: 2019-04-01
  ref <313>: RELEVANT RESIDUES IN SEQ ID NO: (1)..(265)
tttattggagagtttgatcctggctcaggatgaacgctggcggcgtgcctaatacatgcaagtcgagcgaatggattgagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggt

SEQ ID NO: 1826 - DNA, 282 bp, Bacillus sp. cl25
  ref <308>: DATABASE ACCESSION NUMBER: NCBI ACCESSION: NZ_FQZW01000001.1
  ref <309>: DATABASE ENTRY DATE: 2019-04-01
  ref <313>: RELEVANT RESIDUES IN SEQ ID NO: (1)..(282)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcacca

SEQ ID NO: 1827 - DNA, 304 bp, Bacillus sp. ru9509.4
  ref <308>: DATABASE ACCESSION NUMBER: NCBI ACCESSION: NZ_FPJL01000032.1
  ref <309>: DATABASE ENTRY DATE: 2019-04-01
  ref <313>: RELEVANT RESIDUES IN SEQ ID NO: (1)..(304)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgtatggttcaaggatgaaagacggtttcggctgtcacttacagatggacccgcggcgcattagctagttggtgaggtaacggctcaccaaggcgacgatgcgtagccgacctg

SEQ ID NO: 1828 - DNA, 1554 bp, Bacillus testis
  ref <308>: DATABASE ACCESSION NUMBER: NCBI ACCESSION: NZ_LN851186.1
  ref <309>: DATABASE ENTRY DATE: 2019-04-01
  ref <313>: RELEVANT RESIDUES IN SEQ ID NO: (1)..(1554)
ttattggagagtttgatcctggctcaggacgaacgctggcggcgtgcctaatacatgcaagtcgagcggacagaagggagcttgctcccggaagtcagcggcggacgggtgagtaacacgtgggcaacctgcctataagactgggataactccgggaaaccggggctaataccggataggttcttcctccacatggaggaagaaggaaagatggtttcggctatcacttatagatgggcccgcggtgcattagctagttggtaaggtaacggcttaccaaggcaacgatgcatagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggtcctttaagtctgatgtgaaagcccacggctcaaccgtggagggtcattggaaactgggggacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcgaaaccgcgaggtttagccaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttctaa

SEQ ID NO: 1829 - DNA, 271 bp, Bacillus thuringiensis
  ref <308>: DATABASE ACCESSION NUMBER: NCBI ACCESSION: NZ_FNYB01000017.1
  ref <309>: DATABASE ENTRY DATE: 2019-04-01
  ref <313>: RELEVANT RESIDUES IN SEQ ID NO: (1)..(271)
tttattggagagtttgatcctggctcaggatgaacgctggcggcgtgcctaatacatgcaagtcgagcgaatggattaagagcttgctctcaagaagttagcggcggacgggtgagtaacacgtgggtaacctgcccataagactgggataactccgggaaaccggggctaataccggataacattttgaactgcatggttcgaaattgaaaggcggcttcggctgtcacttatggatggacccgcgtcgcattagctagttggtgaggta

SEQ ID NO: 1830 - DNA, 1555 bp, Bacillus trypoxylicola
  ref <308>: DATABASE ACCESSION NUMBER: NCBI ACCESSION: NZ_BCWA01000291.1
  ref <309>: DATABASE ENTRY DATE: 2019-04-01
  ref <313>: RELEVANT RESIDUES IN SEQ ID NO: (1)..(1555)
tttaacggagagtttgatcctggctcaggacgaacgctggcggcgtgcctaatacatgcaagtcgagcggacagaagggagcttgctcctggaagtcagcggcggacgggtgagtaacacgtgggcaacctgccctgtagactgggataacatcgagaaatcggtgctaataccggataatcgaagaaaccgcatggtttctttgtaaaagatggctccggctatcactacgggatgggcccgcggcgcattagctagttggtggggtagaggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccattcaaatagggtggcaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagatcggggctcaaccccgagaggtcattggaaactgggagacttgagtacagaagaggagagtggaattccacgtgtagcggtgaaatgcgtagatatgtggaggaacaccagtggcgaaggcgactctctggtctgtaactgacgctgaggcgcgaaagcgtggggagcaaacaggattagataccctggtagtccacgccgtaaacgatgagtgctaggtgttaggggtttcgatgcccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctttgaccaccctagagatagggctttccccttcgggggacaaagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaagccattctcagttcggattgtaggctgcaactcgcctacatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttcta

SEQ ID NO: 1831 - DNA, 1557 bp, Bacillus tuaregi
  ref <308>: DATABASE ACCESSION NUMBER: NCBI ACCESSION: NZ_LT629731.1
  ref <309>: DATABASE ENTRY DATE: 2019-04-01
  ref <313>: RELEVANT RESIDUES IN SEQ ID NO: (1)..(1557)
ctttattggagagtttgatcctggctcaggacgaacgctggcggcgtgcctaatacatgcaagtcgagcgaatctgagggagcttgctcccgaaggttagcggcggacgggtgagtaacacgtgggcaacctgcctataagactgggataacttcgggaaaccggagctaataccggataattcttttcctctcatgagggaaagctgaaaggcggcttttagctgtcacttatagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactgggagacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctctgacactcctagagataggattttccccttcgggggacagagtgacaggtggtgcatggttgtcgtcagctcgtgtcgtgagatgttgggttaagtcccgcaacgagcgcaacccttgtccttagttgccagcatttagttgggcactctaaggagactgccggtgacaaaccggaggaaggtggggatgacgtcaaatcatcatgccccttatgacctgggctacacacgtgctacaatggatggtacaaagggcagcaaaactgtgaagtcgagcgaatcccataaaaccattctcagttcggattgcaggctgcaactcgcctgcatgaagctggaatcgctagtaatcgcggatcagcatgccgcggtgaatacgttcccgggtcttgtacacaccgcccgtcacaccacgagagtttgtaacacccgaagtcggtggggtaaccgcaaggagccagccgcctaaggtgggacagatgattggggtgaagtcgtaacaaggtagccgtatcggaaggtgcggctggatcacctcctttctaa

SEQ ID NO: 1832 - DNA, 1415 bp, Bacillus velezensis
  ref <308>: DATABASE ACCESSION NUMBER: NCBI ACCESSION: NZ_FNER01000016.1
  ref <309>: DATABASE ENTRY DATE: 2019-04-01
  ref <313>: RELEVANT RESIDUES IN SEQ ID NO: (1)..(1415)
actgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctcctttctaa

SEQ ID NO: 1833 - DNA, 1557 bp, Bacillus vietnamensis
  ref <308>: DATABASE ACCESSION NUMBER: NCBI ACCESSION: NZ_BCVQ01000102.1
  ref <309>: DATABASE ENTRY DATE: 2019-04-01
  ref <313>: RELEVANT RESIDUES IN SEQ ID NO: (1)..(1557)
tttatcggagagtttgatcctggctcaggacgaacgctggcggcgtgcctaatacatgcaagtcgagcggattgatgggagcttgctccctgatatcagcggcggacgggtgagtaacacgtgggtaacctgcctgtaagactgggataactccgggaaaccggggctaataccggataactcatttcctcgcatgaggaaatgttgaaaggtggcttttagctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggcaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagatatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaagatgactgccggtgacaaaccggaggaaggtggggatgacgtcaaatcatcatgccccttatgacctgggctacacacgtgctacaatggacggtacaaagggcagcgagaccgcgaggtttagccaatcccataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgcctaaggtgggacagatgattggggtgaagtcgtaacaaggtagccgtatcggaaggtgcggctggatcacctcctttctaa

SEQ ID NO: 1834 - DNA, 1551 bp, Bacillus xiamenensis
  ref <308>: DATABASE ACCESSION NUMBER: NCBI ACCESSION: NZ_CP017786.1
  ref <309>: DATABASE ENTRY DATE: 2019-04-01
  ref <313>: RELEVANT RESIDUES IN SEQ ID NO: (1)..(1551)
atcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccatgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctcctttctaa

SEQ ID NO: 1835 - DNA, 1521 bp, Bacillus zhangzhouensis
  ref <308>: DATABASE ACCESSION NUMBER: NCBI ACCESSION: NZ_JOTP01000061.1
  ref <309>: DATABASE ENTRY DATE: 2019-04-01
  ref <313>: RELEVANT RESIDUES IN SEQ ID NO: (1)..(1521)
tttttcggagagtttgatcctggctcaggacgaacgctggcggcgtgcctaatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagcgaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgta

SEQ ID NO: 1836 - DNA, 1536 bp, Bacteroides caecimuris
  ref <308>: DATABASE ACCESSION NUMBER: NCBI ACCESSION: NZ_RAYT01000485.1
  ref <309>: DATABASE ENTRY DATE: 2019-04-01
  ref <313>: RELEVANT RESIDUES IN SEQ ID NO: (1)..(1536)
cttttacaatgaagagtttgatcctggctcaggatgaacgctagctacaggcttaacacatgcaagtcgaggggcagcatgggagtttgcttgcaaacttccgatggcgaccggcgcacgggtgagtaacacgtatccaacctgccgataactcggggatagcctttcgaaagaaagattaatatccgatagcatatcaaggtcgcatgatcttgatattaaagaatttcggttatcgatggggatgcgttccattagttagttggcggggtaacggcccaccaagacgacgatggataggggttctgagaggaaggtcccccacattggaactgagacacggtccaaactcctacgggaggcagcagtgaggaatattggtcaatggacgagagtctgaaccagccaagtagcgtgaaggatgactgccctatgggttgtaaacttcttttatatgggaataaaacagggtatgcataccctcttgtatgtaccatatgaataaggatcggctaactccgtgccagcagccgcggtaatacggaggatccgagcgttatccggatttattgggtttaaagggagcgtaggtggattgttaagtcagttgtgaaagtttgcggctcaaccgtaaaattgcagttgaaactggcagtcttgagtacagtagaggtgggcggaattcgtggtgtagcggtgaaatgcttagatatcacgaagaactccgattgcgaaggcagctcactggactgcaactgacactgatgctcgaaagtgtgggtatcaaacaggattagataccctggtagtccacacagtaaacgatgaatactcgctgtttgcgatatacagtaagcggccaagcgaaagcattaagtattccacctggggagtacgccggcaacggtgaaactcaaaggaattgacgggggcccgcacaagcggaggaacatgtggtttaattcgatgatacgcgaggaaccttacccgggcttaaattgcacctgaataacgtggagacatgttagccgcaaggcaggtgtgaaggtgctgcatggttgtcgtcagctcgtgccgtgaggtgtcggcttaagtgccataacgagcgcaacccttatcttcagttactaacaggtcatgctgaggactctggagagactgccgtcgtaagatgtgaggaaggtggggatgacgtcaaatcagcacggcccttacgtccggggctacacacgtgttacaatggggggtacagaaggcagctacctggcgacaggatgctaatccccaaaacctctctcagttcggatcgaagtctgcaacccgacttcgtgaagctggattcgctagtaatcgcgcatcagccatggcgcggtgaatacgttcccgggccttgtacacaccgcccgtcaagccatgaaagccgggggtacctgaagtacgtaaccgcgaggagcgtcctagggtaaaactggtaattggggctaagtcgtaacaaggtagccgtaccggaaggtgcggctggaacacctcctttct

SEQ ID NO: 1837 - DNA, 1540 bp, Bacteroides vulgatus
  ref <308>: DATABASE ACCESSION NUMBER: NCBI ACCESSION: NZ_UYXB01000001.1
  ref <309>: DATABASE ENTRY DATE: 2019-04-01
  ref <313>: RELEVANT RESIDUES IN SEQ ID NO: (1)..(1540)
atttttacaatgaagagtttgatcctggctcaggatgaacgctagctacaggcttaacacatgcaagtcgaggggcagcatggtcttagcttgctaaggctgatggcgaccggcgcacgggtgagtaacacgtatccaacctgccgtctactcttggccagccttctgaaaggaagattaatccaggatgggatcatgagttcacatgtccgcatgattaaaggtattttccggtagacgatggggatgcgttccattagatagtaggcggggtaacggcccacctagtcaacgatggataggggttctgagaggaaggtcccccacattggaactgagacacggtccaaactcctacgggaggcagcagtgaggaatattggtcaatgggcgatggcctgaaccagccaagtagcgtgaaggatgactgccctatgggttgtaaacttcttttataaaggaataaagtcgggtatgcatacccgtttgcatgtactttatgaataaggatcggctaactccgtgccagcagccgcggtaatacggaggatccgagcgttatccggatttattgggtttaaagggagcgtagatggatgtttaagtcagttgtgaaagtttgcggctcaaccgtaaaattgcagttgatactggatgtcttgagtgcagttgaggcaggcggaattcgtggtgtagcggtgaaatgcttagatatcacgaagaactccgattgcgaaggcagcctgctaagctgcaactgacattgaggctcgaaagtgtgggtatcaaacaggattagataccctggtagtccacacggtaaacgatgaatactcgctgtttgcgatatacggcaagcggccaagcgaaagcgttaagtattccacctggggagtacgccggcaacggtgaaactcaaaggaattgacgggggcccgcacaagcggaggaacatgtggtttaattcgatgatacgcgaggaaccttacccgggcttaaattgcactcgaatgatccggaaacggttcagctagcaatagcgagtgtgaaggtgctgcatggttgtcgtcagctcgtgccgtgaggtgtcggcttaagtgccataacgagcgcaacccttgttgtcagttactaacaggtgatgctgaggactctgacaagactgccatcgtaagatgtgaggaaggtggggatgacgtcaaatcagcacggcccttacgtccggggctacacacgtgttacaatggggggtacagagggccgctaccacgcgagtggatgccaatccctaaaacccctctcagttcggactggagtctgcaacccgactccacgaagctggattcgctagtaatcgcgcatcagccacggcgcggtgaatacgttcccgggccttgtacacaccgcccgtcaagccatgggagccgggggtacctgaagtgcgtaaccgcgaggatcgccctagggtaaaactggtgactggggctaagtcgtaacaaggtagccgtaccggaaggtgcggctggaacacctcctttct

SEQ ID NO: 1838 - DNA, 1540 bp, Bacteroides xylanolyticus
  ref <308>: DATABASE ACCESSION NUMBER: NCBI ACCESSION: NZ_PTJA01000030.1
  ref <309>: DATABASE ENTRY DATE: 2019-04-01
  ref <313>: RELEVANT RESIDUES IN SEQ ID NO: (1)..(1540)
ttaatttgagagttcgatcctggctcaggatgaacgctggcggcgtgcttaacacatgcaagtcgagcgaagcgattttaaggaagttttcggatggaattaaaattgacttagcggcggacgggtgagtaacgcgtgggtaacctgcctcatacagggggataacagttagaaatgactgctaataccgcataagcgcacagtgccacatggcacagtgtgaaaaactccggtggtatgagatggacccgcgtctgattaggtagttggtgaggtaatggctcaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtgtttcggcatgtaaagctctatcagcagggaagaaaatgacggtacctgactaagaagccccggctaactacgtgccagcagccgcggtaatacgtagggggcaagcgttatccggatttactgggtgtaaagggagcgtagacggttctgcaagtctggagtgaaagcccggggctcaaccccgggactgctttggaaactgtggaactagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgtcccgtaactgggacttcccttcggggcattccagacaggtggtgcatggttgtcgtcagctcgtgtcgtgagatgttgggttaagtcccgcaacgagcgcaacccttatccttagtagccagcagttcggctgggcactctggggagactgccagggataacctggaggaaggtggggatgacgtcaaatcatcatgccccttatgatttgggctacacacgtgctacaatggcgtaaacaaagggaagcgaaggagtgatctggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 1839 - DNA, 1541 bp, Bariatricus massiliensis
  ref <308>: DATABASE ACCESSION NUMBER: NCBI ACCESSION: NZ_LT574835.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcctaacacatgcaagtcgaacgaagcacttgaactcgaattcttcggaaagaaggttcttgtgactgagtggcggacgggtgagtaacgcgtgggtaacctgcctcatacaaggggataacagttagaaatggctgctaataccgtataagaccacagcaccgcatggtgcggtggtaaaaactccggtggtatgagatggacccgcgtctgattagctggttggcggggtaacggcccaccaaggcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctggagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgatgctcgaaagcgtggggagcaaacaggattagataccctggtagtccacgccgtaaacgatgaatactaggtgtcgggtggcaaagccattcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatcccggtgacagagtatgtaatgtactttcccttcggggcactggagacaggtggtgcatggttgtcgtcagctcgtgtcgtgagatgttgggttaagtcccgcaacgagcgcaacccttatctttagtagccagcatttaaggtgggcactctagagagactgccagggataacctggaggaaggtggggatgacgtcaaatcatcatgccccttatgatcagggctacacacgtgctacaatggcgtaaacaaagggaagcgaggccgcgaggcggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctcctttctaaggaa

SEQ ID NO: 1840 - DNA, 1497 bp, Bartonella alsatica
  ref <308>: DATABASE ACCESSION NUMBER: NCBI ACCESSION: NZ_JH725020.1
  ref <309>: DATABASE ENTRY DATE: 2019-04-01
  ref <313>: RELEVANT RESIDUES IN SEQ ID NO: (1)..(1497)
caaatatgagagtttgatcctggctcagaacgaacgctggcggcaggcttaacacatgcaagtcgagcgcactcttttagggtgagcggcaaacgggtgagtaacgcgtgggaatctacccctctctacggaataacacggagaaatttgtgctaataccgtatacgtccctacggggagaaagatttatcggagatggatgagcccgcgttggattagctagttggtgaggtaatggctccccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1841 - DNA, 1496 bp, Bartonella ancashensis
  ref <308>: DATABASE ACCESSION NUMBER: NCBI ACCESSION: NZ_CP010401.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcttaacacatgcaagtcgagcgcactctttatgagtgagcggcagacgggtgagtaacgcgtgggaatctacccatctctacggaataacacagagaaatttgtgctaataccgtatacgtccttagggagaaagatttatcggagatggatgagcccgcgttggattagctagttggtgaggtaatggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccttggaactgcctttgatactggatgtcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacactttccttcagttaggctggatcggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgaaaccgcaaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttctacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 1842 - DNA, 1495 bp, Bartonella apis
  ref <308>: DATABASE ACCESSION NUMBER: NCBI ACCESSION: NZ_CP015625.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgaacgcacttttcggagtgagtggcagacgggtgagtaacgcgtgggaatctacctatttctacggaataacgcagagaaatttgtgctaataccgtatacgtcctattggagaaagatttatcggagatagatgagcccgcgttggattagctagttggtgaggtaatggcccaccaaggcgacgatccatagctggtctgagaggatgaccagccacattgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcaggggtgaaatcccggggctcaaccccggaactgcctttgatactggatatcttgagtatggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgctgtaaacgatgaatgttagccgttggacagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggatggtggagacaccgtctttcagtttggctggatcggtgacaggtgctgcatggctgtcgtcagctcgtgtcgtgagatgttgggttaagtcccgcaacgagcgcaaccctcgcccttagttgccatcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 1843 - DNA, 1495 bp, Bartonella australis
  ref <308>: DATABASE ACCESSION NUMBER: NCBI ACCESSION: NC_020300.1
  ref <309>: DATABASE ENTRY DATE: 2019-04-01
  ref <313>: RELEVANT RESIDUES IN SEQ ID NO: (1)..(1495)
ttcaatttgagagtttgatcctggctcagaacgaacgctggcggcaggcttaacacatgcaagtcgagcgcactttttaagtgagcggcagacgggtgagtaacgcgtgggaatctacccatttctacggaataacacagagaaatttgtgctaataccgtatacgtccttcgggagaaagatttatcggagatggatgagcccgcgttggattagctagttggtggggtaaaagctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtcttgagtgtggaaggaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttgggcagtttactgctcagtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaagtggagacacattccttcagttaggctggatcggagacaggtgctgcatggctgtcgtcagctcgtgtcgtgagatgttgggttaagtcccgcaacgagcgcaaccctcgcccttagttgccagccttaagttgggcactctaaggggactgccggtgataagccgagaggaaggtggggatgacgtcaagtcctcatggcccttacgggctgggctacacacgtgctacaatggtggtgacagtgggcagcgaggccgcgaggccgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1844 - DNA, 1496 bp, Bartonella bacilliformis
  ref <308>: DATABASE ACCESSION NUMBER: NCBI ACCESSION: NZ_LQWW01000011.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcttaacacatgcaagtcgagcgcactctttttgagtgagcggcagacgggtgagtaacgcgtgggaatctacccatctctacggaataacacagagaaatttgtgctaataccgtatacgtccttcgggagaaagatttatcggagatggatgagcccgcgttggattagctagttggtgaggtaacggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcagaggtgaaatcccagggctcaaccttggaactgcctttgatactggatgtctcgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacactttccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgaaaccgcaaggtcgagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaagcaggcaaccacggtagggtcagcgactggggtgaagtcgtaacaaggtagccgtaggggaacctgcggctggatcacctcctttctaagg

SEQ ID NO: 1845 - DNA, 1498 bp, Bartonella birtlesii
  ref <308>: DATABASE ACCESSION NUMBER: NCBI ACCESSION: NZ_KE007222.1
  ref <309>: DATABASE ENTRY DATE: 2019-04-01
  ref <313>: RELEVANT RESIDUES IN SEQ ID NO: (1)..(1498)
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtcccttcggggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatgtcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1846 - DNA, 1494 bp, Bartonella bovis
  ref <308>: DATABASE ACCESSION NUMBER: NCBI ACCESSION: NZ_MWVG01000032.1
  ref <309>: DATABASE ENTRY DATE: 2019-04-01
  ref <313>: RELEVANT RESIDUES IN SEQ ID NO: (1)..(1494)
tcaacttgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaatgccgtatacgtcctaagggagaaagatttatcggagatggatgagcccgcgttggattagctagttggtggggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacacactccttcagttaggctggatcggagacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggtggtgacaatgggcagcgaaaccgcaaggtggagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaag

SEQ ID NO: 1847 - DNA, 1496 bp, Bartonella clarridgeiae
  ref <308>: DATABASE ACCESSION NUMBER: NCBI ACCESSION: NZ_KI912397.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcttaacacatgcaagtcgagcgcactcatttagagtgagcggcagacgggtgagtaacgcgtgggaatctacccttttctacggaataacacagagaaatttgtgctaataccgtatacgtcctactggagaaagatttatcggagaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttgggtggtttactgctcagtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcgggaagtggagacacctcccttcagttcggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgtggatcagcatgctacggtgaatacgttcccgggccttgtacacaccgcccgtcacaccatgggagttggttttacccgaaggtgctgtgctaaccgcaaggaggcaggtaaccacggtagggtcagcgactggggtgaagtcgtaacaaggtagccgtaggggaacctgtggctggatcacctcctttctaagg

SEQ ID NO: 1848 - DNA, 1494 bp, Bartonella doshiae
  ref <308>: DATABASE ACCESSION NUMBER: NCBI ACCESSION: NZ_UFTF01000001.1
  ref <309>: DATABASE ENTRY DATE: 2019-04-01
  ref <313>: RELEVANT RESIDUES IN SEQ ID NO: (1)..(1494)
tcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttagggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaag

SEQ ID NO: 1849 - DNA, 1496 bp, Bartonella elizabethae
  ref <308>: DATABASE ACCESSION NUMBER: NCBI ACCESSION: NZ_LR134527.1
  ref <309>: DATABASE ENTRY DATE: 2019-04-01
  ref <313>: RELEVANT RESIDUES IN SEQ ID NO: (1)..(1496)
tcaatatgagagtttgatcctggctcagaacgaacgctggcggcaggcttaacacatgcaagtcgagcgcgctccttttggagcgagcggcaaacgggtgagtaacgcgtgggaatctacccctctctacggaataacacagagaaatttgtgctaataccgtatacgtccctttgggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacactctccttcagttaggctggatcggagacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaag

SEQ ID NO: 1850 - DNA, 1497 bp, Bartonella florencae
  ref <308>: DATABASE ACCESSION NUMBER: NCBI ACCESSION: NZ_HE997457.1
  ref <309>: DATABASE ENTRY DATE: 2019-04-01
  ref <313>: RELEVANT RESIDUES IN SEQ ID NO: (1)..(1497)
ttcaatatgagagtttgatcctggctcagaacgaacgctggcggcaggcttaacacatgcaagtcgagcgcgctcctctggagcgagcggcaaacgggtgagtaacgcgtgggaatctacccatctctacggaataacacagagaaatttgtgctaataccgtatgcgtcctttttggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacaccctccttcagttaggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1851 - DNA, 1496 bp, Bartonella henselae
  ref <308>: DATABASE ACCESSION NUMBER: NCBI ACCESSION: NZ_CP020742.1
  ref <309>: DATABASE ENTRY DATE: 2019-04-01
  ref <313>: RELEVANT RESIDUES IN SEQ ID NO: (1)..(1496)
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttagggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcatttggttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaagggggcaggcaaccacggtagggtcagcgactggggtgaagtcgtaacaaggtagccgtaggggaacctgtggctggatcacctcctttctaagg

SEQ ID NO: 1852 - DNA, 1496 bp, Bartonella koehlerae
  ref <308>: DATABASE ACCESSION NUMBER: NCBI ACCESSION: NZ_KL407334.1
  ref <309>: DATABASE ENTRY DATE: 2019-04-01
  ref <313>: RELEVANT RESIDUES IN SEQ ID NO: (1)..(1496)
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttagggagaaagatttatcggagatggatgagcccgcgttggattagctagttggtgaggtaacggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1853 - DNA, 1493 bp, Bartonella melophagi
  ref <308>: DATABASE ACCESSION NUMBER: NCBI ACCESSION: NZ_JH725081.1
  ref <309>: DATABASE ENTRY DATE: 2019-04-01
  ref <313>: RELEVANT RESIDUES IN SEQ ID NO: (1)..(1493)
acttgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaatgccgtatacgtccttaagggagaaagatttatcggagatggatgagcccgcgttggattagctagttggtggggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgctgtaaacgatgaatgttagccgtcgggtggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacacactccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacaatgggcagccaaaccgcaaggtggagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 1854 - DNA, 1495 bp, Bartonella quintana
  ref <308>: DATABASE ACCESSION NUMBER: NCBI ACCESSION: NZ_LS483373.1
  ref <309>: DATABASE ENTRY DATE: 2019-04-01
  ref <313>: RELEVANT RESIDUES IN SEQ ID NO: (1)..(1495)
tcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccctctgggagaaagatttatcggaggtggatgagcccgcgttggattagctagttggtgaggtaagggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacgttaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtctcgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactactcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggtgacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaag

SEQ ID NO: 1855 - DNA, 1496 bp, Bartonella rattaustraliani
  ref <308>: DATABASE ACCESSION NUMBER: NCBI ACCESSION: NZ_CALW02000074.1
  ref <309>: DATABASE ENTRY DATE: 2019-04-01
  ref <313>: RELEVANT RESIDUES IN SEQ ID NO: (1)..(1496)
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttagggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacaccctccttcagttaggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacaatgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1856 - DNA, 1497 bp, Bartonella rattimassiliensis
  ref <308>: DATABASE ACCESSION NUMBER: NCBI ACCESSION: NZ_CALY02000061.1
  ref <309>: DATABASE ENTRY DATE: 2019-04-01
  ref <313>: RELEVANT RESIDUES IN SEQ ID NO: (1)..(1497)
ttcaatatgagagtttgatcctggctcagaacgaacgctggcggcaggcttaacacatgcaagtcgagcgcactctttttagagtgagcggcaaacgggtgagtaacgcgtgggaatctacccatttctacggaataacacagagaaatttgtgctaataccgtatacgtcctattggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggcttaaccctggaactgcctttgatactggatatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccatcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1857 - DNA, 1495 bp, Bartonella rochalimae
  ref <308>: DATABASE ACCESSION NUMBER: NCBI ACCESSION: NZ_KL407338.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgcactcttatgagtgagcggcagacgggtgagtaacgcgtgggaatctacccttttctacggaataacacagagaaatttgtgctaataccgtatacgtcctactggagaaagatttatcggagaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcgtgtaggcggatatttaagtcagaggtgaaatcccagggctcaaccctggaactgcctttgatactggatgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttgggtggtttactgctcagtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcgggaagtggagacacttcccttcagttcggctggatcggagacaggtgctgcatggctgtcgtcagctcgtgtcgtgagatgttgggttaagtcccgcaacgagcgcaaccctcgcccttagttgccagcatttagttgggcactctagggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggtaaccacggtagggtcagcgactggggtgaagtcgtaacaaggtagccgtaggggaacctgtggctggatcacctcctttctaagg

SEQ ID NO: 1858 - DNA, 1496 bp, Bartonella schoenbuchensis
  ref <308>: DATABASE ACCESSION NUMBER: NCBI ACCESSION: NZ_CP019789.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaatgccgtatacgtcctgagggagaaagatttatcggagatggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacacactccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacaatgggcagcgaaaccgcaaggtggagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 1859 - DNA, 1496 bp, Bartonella senegalensis
  ref <308>: DATABASE ACCESSION NUMBER: NCBI ACCESSION: NZ_HE997546.1
  ref <309>: DATABASE ENTRY DATE: 2019-04-01
  ref <313>: RELEVANT RESIDUES IN SEQ ID NO: (1)..(1496)
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtcccttgggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacaccctccttcagttaggctggatcggagacaggtgctgcatggctgtcgtcagctcgtgtcgtgagatgttgggttaagtcccgcaacgagcgcaaccctcgcccttagttgccagcattaggttgggcactctagggggactgccggtgataagccgagaggaaggtggggatgacgtcaagtcctcatggcccttacgggctgggctacacacgtgctacaatggtggtgacaatgggcagccagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaagctgctgtgctaaccgcaaggaggcaggcaaccacggtagggtcagcgactggggtgaagtcgtaacaaggtagccgtaggggaacctgtggctggatcacctcctttctaagg

SEQ ID NO: 1860 - DNA, 1493 bp, Bartonella sp. 1-1C
  ref <308>: DATABASE ACCESSION NUMBER: NCBI ACCESSION: NZ_CP019489.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgcactcttatgagtgagcggcagacgggtgagtaacgcgtgggaatctacccttttctacggaataacacagagaaatttgtgctaataccgtatacgtcctactggagaaagatttatcggagaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttgggtggtttactgctcagtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcaggaagtggagacacttcccttcagttcggctggatcggagacaggtgctgcatggctgtcgtcagctcgtgtcgtgagatgttgggttaagtcccgcaacgagcgcaaccctcgcccttagttgccagcatttagttgggcactctagggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggtaaccacggtagggtcagcgactggggtgaagtcgtaacaaggtagccgtaggggaacctgtggctggatcacctcctttctaag

SEQ ID NO: 1861 - DNA, 1495 bp, Bartonella sp. 114
  ref <308>: DATABASE ACCESSION NUMBER: NCBI ACCESSION: NZ_CP019784.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgcactcttatgagtgagcggcagacgggtgagtaacgcgtgggaatctacccttttctacggaataacacagagaaatttgtgctaataccgtatacgtcctactggagaaagatttatcggagaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttgggtggtttactgctcagtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcgggaagtggagacacttcccttcagttcggctggatcggagacaggtgctgcatggctgtcgtcagctcgtgtcgtgagatgttgggttaagtcccgcaacgagcgcaaccctcgcccttagttgccagcatttagttgggcactctagggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggtaaccacggtagggtcagcgactggggtgaagtcgtaacaaggtagccgtaggggaacctgtggctggatcacctcctttctaagg

SEQ ID NO: 1862 - DNA, 1495 bp, Bartonella sp. 11B; identical to SEQ ID NO: 1861
  ref <308>: DATABASE ACCESSION NUMBER: NCBI ACCESSION: NZ_CP019783.1
  ref <309>: DATABASE ENTRY DATE: 2019-04-01
  ref <313>: RELEVANT RESIDUES IN SEQ ID NO: (1)..(1495)

SEQ ID NO: 1863 - DNA, 1495 bp, Bartonella sp. A1379B; identical to SEQ ID NO: 1861
  ref <308>: DATABASE ACCESSION NUMBER: NCBI ACCESSION: NZ_CP019780.1
  ref <309>: DATABASE ENTRY DATE: 2019-04-01
  ref <313>: RELEVANT RESIDUES IN SEQ ID NO: (1)..(1495)

SEQ ID NO: 1864 - DNA, 1495 bp, Bartonella sp. AR 15-3
  ref <308>: DATABASE ACCESSION NUMBER: NCBI ACCESSION: NZ_MUYE01000001.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgcactcttatgagtgagcggcagacgggtgagtaacgcgtgggaatctacccttttctacggaataacacagagaaatttgtgctaataccgtatacgtcctactggagaaagatttatcggagaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgctgtaaacgatgaatgttagccgttgggtggtttactgctcagtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcgggaagtggagacacctcccttcagttcggctggatcggagacaggtgctgcatggctgtcgtcagctcgtgtcgtgagatgttgggttaagtcccgcaacgagcgcaaccctcgcccttagttgccagcatttagttgggcactctagggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggtaaccacggtagggtcagcgactggggtgaagtcgtaacaaggtagccgtaggggaacctgtggctggatcacctcctttctaagg

SEQ ID NO: 1865 - DNA, 1495 bp, Bartonella sp. CDC skunk
  ref <308>: DATABASE ACCESSION NUMBER: NCBI ACCESSION: NZ_CP019782.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgcactcttatgagtgagcggcagacgggtgagtaacgcgtgggaatctacccttttctacggaataacatagagaaatttgtgctaataccgtatacgtcctactggagaaagatttatcggagaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttgggtggtttactgctcagtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcgggaagtggagacacttcccttcagttcggctggatcggagacaggtgctgcatggctgtcgtcagctcgtgtcgtgagatgttgggttaagtcccgcaacgagcgcaaccctcgcccttagttgccagcatttagttgggcactctagggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggtaaccacggtagggtcagcgactggggtgaagtcgtaacaaggtagccgtaggggaacctgtggctggatcacctcctttctaagg

SEQ ID NO: 1866 - DNA, 1495 bp, Bartonella sp. Coyote22sub2; identical to SEQ ID NO: 1861
  ref <308>: DATABASE ACCESSION NUMBER: NCBI ACCESSION: NZ_CP019785.1
  ref <309>: DATABASE ENTRY DATE: 2019-04-01
  ref <313>: RELEVANT RESIDUES IN SEQ ID NO: (1)..(1495)

SEQ ID NO: 1867 - DNA, 1497 bp, Bartonella sp. DB5-6
  ref <308>: DATABASE ACCESSION NUMBER: NCBI ACCESSION: NZ_JH725117.1
  ref <309>: DATABASE ENTRY DATE: 2019-04-01
  ref <313>: RELEVANT RESIDUES IN SEQ ID NO: (1)..(1497)
ttcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttctgggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1868 - DNA, 1495 bp, Bartonella sp. JB15
  ref <308>: DATABASE ACCESSION NUMBER: NCBI ACCESSION: NZ_CP019787.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgcactcttttgagtgagcggcagacgggtgagtaacgcgtgggaatctacccttttctacggaataacacagagaaatttgtgctaataccgtatacgtcctactggagaaagatttatcggagaaggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactggatatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgttgggtggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcgggaagtggagacacctcccttcagttcggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacagtgggcagcgagatcgcaaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgtaagggggcaggtaaccacggtagggtcagcgactggggtgaagtcgtaacaaggtagccgtaggggaacctgtggctggatcacctcctttctaagg

SEQ ID NO: 1869 - DNA, 1495 bp, Bartonella sp. JB63; identical to SEQ ID NO: 1868
  ref <308>: DATABASE ACCESSION NUMBER: NCBI ACCESSION: NZ_CP019788.1
  ref <309>: DATABASE ENTRY DATE: 2019-04-01
  ref <313>: RELEVANT RESIDUES IN SEQ ID NO: (1)..(1495)

SEQ ID NO: 1870 - DNA, 1496 bp, Bartonella sp. OE 1-1
  ref <308>: DATABASE ACCESSION NUMBER: NCBI ACCESSION: NZ_CP031844.1
  ref <309>: DATABASE ENTRY DATE: 2019-04-01
  ref <313>: RELEVANT RESIDUES IN SEQ ID NO: (1)..(1496)
tcaatatgagagtttgatcctggctcagaacgaacgctggcggcaggcttaacacatgcaagtcgagcgcgctcttttagagcgagcggcaaacgggtgagtaacgcgtgggaatctacccatttctacggaataacacagagaaatttgtgctaataccgtatacgtcccttttgggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaag

SEQ ID NO: 1871 - DNA, 1495 bp, Bartonella sp. Raccoon60; identical to SEQ ID NO: 1865
  ref <308>: DATABASE ACCESSION NUMBER: NCBI ACCESSION: NZ_CP019786.1
  ref <309>: DATABASE ENTRY DATE: 2019-04-01
  ref <313>: RELEVANT RESIDUES IN SEQ ID NO: (1)..(1495)

SEQ ID NO: 1872 - DNA, 1496 bp, Bartonella sp. Tel Aviv; identical to SEQ ID NO: 1849
  ref <308>: DATABASE ACCESSION NUMBER: NCBI ACCESSION: NZ_CP031843.1
  ref <309>: DATABASE ENTRY DATE: 2019-04-01
  ref <313>: RELEVANT RESIDUES IN SEQ ID NO: (1)..(1496)

SEQ ID NO: 1873 - DNA, 1496 bp, Bartonella sp. WD12.1
  ref <308>: DATABASE ACCESSION NUMBER: NCBI ACCESSION: NZ_MUBG01000001.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaatgccgtatacgtcctgagggagaaagatttatcggagatggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcagaggtgaaatcccagggctcaaccctggaactgcctttgatactgggtatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacacactccttcagttaggctggatcggagacaggtgctgcatggctgtcgtcagctcgtgtcgtgagatgttgggttaagtcccgcaacgagcgcaaccctcgcccttagttgccagcattaagttgggcactctagggggactgccggtgataagccgagaggaaggtggggatgacgtcaagtcctcatggcccttacgggctgggctacacacgtgctacaatggtggtgacaatgggcagcgaaaccgcaaggtggagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgtaaggaggcaggcaaccacggtagggtcagcgactggggtgaagtcgtaacaaggtagccgtaggggaacctgcggctggatcacctcctttctaagg

SEQ ID NO: 1874 - DNA, 1496 bp, Bartonella sp. WD16.2
  ref <308>: DATABASE ACCESSION NUMBER: NCBI ACCESSION: NZ_CP019781.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaatgccgtatacgtcctaagggagaaagatttatcggagatggatgagcccgcgttggattagctagttggtggggtaaaggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtagccggagaagaagccccggctaacttcgtgccagcagccgcggtaatacgaagggggctagcgttgttcggatttactgggcgtaaagcgcatgtaggcggatatttaagtcaggggtgaaatcccagggctcaaccctggaactgcctttgatactggatatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggtggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggagagtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacaatgggcagccaaaccgcaaggtggagctaatctccaaaagccatctcagttcggattgcactctgcaactcgagtgcatgaagtcggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcaactggggtgaagtcgtaacaaggtagccgtaggggaacctgcggctggatcacctcctttctaagg

SEQ ID NO: 1875 - DNA, 1495 bp, Bartonella tamiae
  ref <308>: DATABASE ACCESSION NUMBER: NCBI ACCESSION: NZ_JH725021.1
  ref <309>: DATABASE ENTRY DATE: 2019-04-01
  ref <313>: RELEVANT RESIDUES IN SEQ ID NO: (1)..(1495)
ttcaacttgagagtttgatcctggctcagaacgaacgctggcggcaggcttaacacatgcaagtcgagcgcacttttcggagtgagcggcagacgggtgagtaacacgtgggaatctacccatctctacggaataacacagagaaatttgtgctaataccgtatacgtccttatggagaaagatttatcggagatggatgagcccgcgttggattagctagttggtagggtaaaggcttaccaaggcgacgatccatagctggtctgagaggatgatcagccacactgggactgagacacggcccagactcctacgggaggcagcagtggggaatattggacaatgggcgaaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacatttaagtcagaggtgaaatcccagggctcaaccctggaactgcctttgatactgggtgtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggacagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactttccttcagttaggctggatcggtgacaggtgctgcatggctgtcgtcagctcgtgtcgtgagatgttgggttaagtcccgcaacgagcgcaaccctcgcccttagttgccatcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgcggctggatcacctcctttctaagg

SEQ ID NO: 1876 - DNA, 1497 bp, Bartonella taylorii
  ref <308>: DATABASE ACCESSION NUMBER: NCBI ACCESSION: NZ_MUYW01000033.1
  ref <309>: DATABASE ENTRY DATE: 2019-04-01
  ref <313>: RELEVANT RESIDUES IN SEQ ID NO: (1)..(1497)
caaatatgagagtttgatcctggctcagaacgaacgctggcggcaggcttaacacatgcaagtcgagcgcactcctttggagtgagcggcaaacgggtgagtaacgcgtgggaatctacccatctctacggaataacacagagaaatttgtgctaataccgtatacgtcccttcggggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcgccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatgtcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaagg

SEQ ID NO: 1877 - DNA, 1495 bp, Bartonella tribocorum
  ref <308>: DATABASE ACCESSION NUMBER: NCBI ACCESSION: NZ_NJPP01000017.1
  ref <309>: DATABASE ENTRY DATE: 2019-04-01
  ref <313>: RELEVANT RESIDUES IN SEQ ID NO: (1)..(1495)
tcaatatgagagtttgatcctggctcagaacgaacgctggcggcaggcttaacacatgcaagtcgagcgcactcttttagagtgagcggcaaacgggtgagtaacgcgtgggaatctacccctctctacggaataacacagagaaatttgtgctaataccgtatacgtccctatgggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactggatatcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggttcactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaag

SEQ ID NO: 1878 - DNA, 1494 bp, Bartonella vinsonii
  ref <308>: DATABASE ACCESSION NUMBER: NCBI ACCESSION: NZ_LR134529.1
  ref <309>: DATABASE ENTRY DATE: 2019-04-01
  ref <313>: RELEVANT RESIDUES IN SEQ ID NO: (1)..(1494)
tcaatatgagagtttgatcctggctcagaacgaacgctggcggcaggcttaacacatgcaagtcgagcgcactcttttagagtgagcggcaaacgggtgagtaacgcgtgggaatctacccatctctacggaataacacagagaaatttgtgctaataccgtatacgtccttagggagaaagatttatcggagatggatgagcccgcgttggattagctagttggtgaggtaacggctcaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggatatttaagtcagaggtgaaatcccagggctcaaccctggaactgcctttgatactgggtatcttgagtatggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaag

SEQ ID NO: 1879 - DNA, 1496 bp, Bartonella washoeensis
  ref <308>: DATABASE ACCESSION NUMBER: NCBI ACCESSION: NZ_UAQI01000042.1
  ref <309>: DATABASE ENTRY DATE: 2019-04-01
  ref <313>: RELEVANT RESIDUES IN SEQ ID NO: (1)..(1496)
tcaatatgagagtttgatcctggctcagaacgaacgctggcggcaggcttaacacatgcaagtcgagcgcactcttttagagtgagcggcaaacgggtgagtaacgcgtgggaatctacccctctctacggaataacacagagaaatttgtgctaataccgtatacgtcccttttgggagaaagatttatcggagatggatgagcccgcgttggattagctagttggtgaggtaacggcccaccaaggcgacgatccatagctggtctgagaggatgatcagccacactgggactgagacacggcccagactcctacgggaggcagcagtggggaatattggacaatgggggcaaccctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcatgtaggcggacatttaagtcagaggtgaaatcccagggctcaaccctggaactgcctttgatactgggtgtcttgagtgtggaagaggtgagtggaattccgagtgtagaggtaaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcggtttactgctcggtggcgcagctaacgcgttaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggaaggtggagacaccctccttcagttaggctggatcggagacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggtgctgtgctaaccgcaaggaggcaggcaaccacggtagggtcagcgactggggtgaagtcgtaacaaggtagccgtaggggaacctgtggctggatcacctcctttctaag

SEQ ID NO: 1880 - DNA, 1540 bp, Bathymodiolus thermophilus thioautotrophic gill symbiont
  ref <308>: DATABASE ACCESSION NUMBER: NCBI ACCESSION: NZ_CP024634.1
  ref <309>: DATABASE ENTRY DATE: 2019-04-01
  ref <313>: RELEVANT RESIDUES IN SEQ ID NO: (1)..(1540)
attaaactgaagagtttgatcctggctcagattgaacgctggcggtatgcttaacacatgcaagtcgaacggaaacgataagagcttgctcttaggcgtcgagtggcggacgggtgagtaacgcgtaggaatctgcctagtagtgggggatagcccagagaaatctggattaataccgcataatatctatggattaaagtggaggatcttcggacttcacgctactagatgagcctgcgtaagattagcttgttggtgaggtaaaagctcaccaaggcgacgatctttagctggtctgagaggatgatcagccacactgggactgagacacggcccagactcctacgggaggcagcagtggggaatattggacaatgggggcaaccctgatccagcaataccgcgtgtgtgaagaaggcctgagggttgtaaagcactttcaattgggaagaaaagctaatggttaatacccattagccttgacgttacctttagaagaagcaccggctaactccgtgccagcagccgcggtaatacggagggtgcaagcgttaatcggaattactgggcgtaaagcgtgcgtaggtggtttgttaagtcagatgtgaaagccctgggctcaacctaggaactgcatttgaaactggcaaactagagtataggagaggaaagtggaatttcaggtgtagcggtgaaatgcgtagatatctgaaggaacatcaatggcgaaggcagctttctggactaatactgacactgaggtacgaaagcgtgggtagcaaacaggattagataccctggtagtccacgccgtaaacgatgacaactagccgttgggaggatttacctcttagtggcgaagctaacgcgttaagttgtccgcctggggagtacggccgcaaggttaaaactcaaaggaattgacggggacccgcacaagcggtggagcatgtggtttaattcgatgcaacgcgaagaaccttacctggtcttgacatacacggaactttccagagatggattggtgccttcgggaaccgtgatacaggtgctgcatggctgtcgtcagctcgtgtcgtgagatgttgggttaagtcccgtaacgagcgcaacccttatctttatttgccagcacatcatggtgggaactataaagagactgccggtgataaaccggaggaaggcggggacgacgtcaagtcatcatggcccttacgaccagggctacacacgtgctacaatgggaaggacaaagggtcgcaacctcgcgagagcaagctaatctcataaaccttttcgtagtccggatcggagtctgcaactcgactccgtgaagtcggaatcgctagtaatcgtagatcagaacgctacggtgaatacgttcccgggtcttgtacacaccgcccgtcataccatgggagtgggttgcaaaagaagtgggtagcttatctgggcgctcaccactttgtgattcatgactggggtaaagtcgtaacaaggtagccctagcggaagctggggctggatcacctccttaaga

SEQ ID NO: 1881 - DNA, 1246 bp, Bavariicoccus seileri
  ref <308>: DATABASE ACCESSION NUMBER: NCBI ACCESSION: NZ_ATXL01000106.1
  ref <309>: DATABASE ENTRY DATE: 2019-04-01
  ref <313>: RELEVANT RESIDUES IN SEQ ID NO: (1)..(1246)
gatcggccacattgggactgagacacggcccaaactcctacgggaggcagcagtagggaatcttccgcaatggacgaaagtctgacggagcaacgccgcgtgagtgaagaaggttttcggatcgtaaaactctgttgttagagaagaacatgtctgagagtaactgttcaggcaatgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccacggcttaaccgtggagggtcattggaaactgggaaacttgagtgcagaagaggagagtggaattccatgtgtagcggtgaaatgcgtagatatatggaggaacaccagtggcgaaggcgactctctggtctgtaactgacgctgaggctcgaaagcgtgggtagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccactctagagatagagcttccccttcgggggcaaagtgacaggtggtgcatggttgtcgtcagctcgtgtcgtgagatgttgggttaagtcccgcaacgagcgcaacccttatcattagttgccagcatttagttgggcactctagtgatactgccggtgacaaaccggaggaaggtggggatgacgtcaaatcagcatgccccttatgacttgggctacacacgtgctacaatggatggtacaacgagcagcgaactcgcgagagtcagcgaatctctaaaagccattctcagttcggattgcaggctgcaactcgcctgcatgaagccggaatcgctagtaatcgcggatcagcacgccgcggtgaatccgttcccgggtcttgtacacaccgcccgtcacaccacgagagtttgtaacacccaaagtcggtgaggtaaccattcggagccagccgcctaaggtgggacagatgattggggtgaagtcgtaacaaggtagccgtatcggaaggtgcggctggatcacctcctttctaaggaa

SEQ ID NO: 1882 - DNA, 1520 bp, Bdellovibrio exovorus
  ref <308>: DATABASE ACCESSION NUMBER: NCBI ACCESSION: NC_020813.1
  ref <309>: DATABASE ENTRY DATE: 2019-04-01
  ref <313>: RELEVANT RESIDUES IN SEQ ID NO: (1)..(1520)
tttaactggagagtttgattctggctcagaacaaacgctggcggcgtgcctaatacatgcaagtcgaacggggaaagctttcgggtgagtactagtggcgcacgggtgaggaatacatgggtaatctgccctcgagttggggataactagtcgaaagattagctaataccgaataagaccacaggatctgcggatctaggggttaaaggtttttcgcttgaggatgagcccatgtgggattagctagttggtggggtaatggcctaccaaggcgacgatccctaactggtcttagaggatgatcagtcacactggaactgagacacggtccagactcctacgggaggcagcagtagggaatattgcacaatgggggaaaccctgatgcagcgacgccgcgtgagtgatgaaggccttcgggtcgtaaagctctgtcgtatgggactaacacaatgaaggtaccatgcaagaaaggatcggctaacttcgtgccagcagccgcggtaagacgagggatcctagcgttgttcggaattattgggcgtaaagcgggtgtaggcgggcttataagtcaggtgtgaaatcccagggctcaaccctggaagtgcacttgatactgtaagtcttgagtgtggtagaggctattagaattcttggtgtagtggtgaaatacgtagatatcaagaggaataccggaggcgaaggcggatagctgggccaacactgacgctgagacccgaaagcgtggggatcaaacaggattagataccctggtagtccacgccgtaaacgatggatacttgttgttagtggtattgaccccactagtgacgtagctaacgcgttaagtatcccgcctggggagtacggtcgcaagattaaaactcaaagaaattgacgggggcccgcacaagcggtggagcatgtggtttaattcgatgcaacgcgaagaaccttacctaggcttgacatggactggaagagtggcagaaatgtcctcgctcgcaagagtcggttcacaggtgctgcatggctgtcgtcagctcgtgtcgtgagatgttgggttaagtcccgcaacgagcgcaacccttacctttagttgccagcatttagttgggcactctaaagggactgcctgcgttaagcaggaggaaggtggggatgacgtcaagtcctcatggcccttatgcctagggctacacacgtgctacaatggtggtcacagagggaagccaaaccgcgaggtggagctaatcccttaaaagccatctaagttcagattggtctctgcaactcgagaccatgaagttggaatcgctagtaatcgcggatcagaatgccgcggtgaatacgttcccgggccttgtacacaccgcccgtcacaccatgaaagttggtcgtaccagaagtcgctgtgctaaccgcaaggaggtaggcgcccaaggtatggtcgatgattggggtgaagtcgtaacaaggtagccgtaggggaacctgcggctggatcacctcctttctaa

SEQ ID NO: 1883 - DNA, 1497 bp, Beijerinckia indica
  ref <308>: DATABASE ACCESSION NUMBER: NCBI ACCESSION: NC_010581.1
  ref <309>: DATABASE ENTRY DATE: 2019-04-01
  ref <313>: RELEVANT RESIDUES IN SEQ ID NO: (1)..(1497)
atttaacttgagagtttgatcctggctcagaacgaacgctggcggcaggcctaacacatgcaagtcgaacgctgtagcaatacggagtggcagacgggtgagtaacacgtgggaacataccctttggttcggaataactcagggaaacttgggctaataccggatacgccctacgggggaaagatttattgccgaaggattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttacctgggaagataatgacggtaccaggagaataagccccggctaacttcgtgccagcagccgcggtaatacgaagggggctagcgttgttcggatttactgggcgtaaagcgcacgtaggcggatctttaagtcaggggtgaaatcccaaggctcaaccttggaactgcctttgatactggggatctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccaacctttgacatgtctcgtttggttaccagagatggtttccttcagttaggctggcgagaacacaggtgctgcatggctgtcgtcagctcgtgtcgtgagatgttgggttaagtcccgcaacgagcgcaacccacgcccttagttgccatcattcagttgggcactctagggggactgccggtgataagccgagaggaaggtgtggatgacgtcaagtcctcatggcccttacgggttgggctacacacgtgctacaatggcggtgacaatgggatgcgaaggggcgaccctcagcaaatctcaaaaagccgtctcagttcggattgtactctgcaactcgagtgcatgaagttggaatcgctagtaatcgtagatcagaacgctacggtgaatacgttcccgggccttgtacacaccgcccgtcacaccatgggagttggttctacccgaaggcgttttgctaaccgcaagggggcaggcgaccacggtagggtcagcgactggggtgaagtcgtaacaaggtagccgtaggggaacctgcggctggatcacctcctttctaagga

SEQ ID NO: 1884 - DNA, 1498 bp, Beijerinckia mobilis
  ref <308>: DATABASE ACCESSION NUMBER: NCBI ACCESSION: NZ_JQJH01000049.1
  ref <309>: DATABASE ENTRY DATE: 2019-04-01
  ref <313>: RELEVANT RESIDUES IN SEQ ID NO: (1)..(1498)
aattcaacttgagagtttgatcctggctcagaacgaacgctggcggcaggcctaacacatgcaagtcgaacgccgtagcaatacggagtggcagacgggtgagtaacgcgtgggaacgtaccctttggttcggaataactcagggaaacttgggctaataccggatacgtccgagaggagaaagatttatcgccgaaggatcggcccgcgtctgattagctagttggtgtggtaatggcgcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgacggccttagggttgtaaagctcttttacctgggaagataatgacggtaccaggagaataagccccggctaacttcgtgccagcagccgcggtaatacgaagggggctagcgttgttcggatttactgggcgtaaagcgcacgtaggcggatttttaagtcaggggtgaaatcccaaggctcaaccttggaactgcctttgatactggagatcttgagtccgggagaggtgagtggaactgcgagtgtagaggtgaaattcgtagatattcgcaagaacaccagtggcgaaggcggctcactggcccggaactgacgctgaggtgcgaaagcgtggggagcaaacaggattagataccctggtagtccacgccgtaaacgatggatgctagccgttaggcagcttgctgcttagtggcgcagttaacgctttaagcatcccgcctggggagtacggtcgcaagattaaaactcaaaggaattgacgggggcccgcacaagcggtggagcatgtggtttaattcgaagcaacgcgcagaaccttaccaacctttgacatgtctcgtttggttaccagagatggtttccttcagttcggctggcgagaacacaggtgctgcatggctgtcgtcagctcgtgtcgtgagatgttgggttaagtcccgcaacgagcgcaacccacgcccttagttgccatcatttagttgggcactctagggggactgccggtgataagccgagaggaaggtgtggatgacgtcaagtcctcatggcccttacgggttgggctacacacgtgctacaatggcggtgacaatgggatgcgaaggggcgacccttagcaaatctccaaaatccgtctcagttcggattgcactctgcaactcgagtgcatgaaggtggaatcgctagtaatcgtagatcagaacgctacggtgaatacgttcccgggccttgtacacaccgcccgtcacaccatgggagttggttctacccgaaggcgttttgctaaccgcaagggggcaggcgaccacggtagggtcagcgactggggtgaagtcgtaacaaggtagccgtaggggaacctgcggctggatcacctcctttctaagga

SEQ ID NO: 1885 - DNA, 1527 bp, Belliella baltica
  ref <308>: DATABASE ACCESSION NUMBER: NCBI ACCESSION: NC_018010.1
  ref <309>: DATABASE ENTRY DATE: 2019-04-01
  ref <313>: RELEVANT RESIDUES IN SEQ ID NO: (1)..(1527)
tttacaatggagagtttgatcctggctcaggatgaacgctagcggcaggcctaatacatgcaagtcgaacgggatttgagacttcggttttgatgagagtggcgcacgggtgcgtaacgcgtatgcaacctacctattacagggggatagcccgaggaaacccggattaataccccatggtattatgagcaggcatctgtttataattaaagatttatcggtaatagatgggcatgcgtaggattagctagttggtaaggtaacggcttaccaaggctatgatccttaggggttctgagaggaaggtcccccacactggtactgagatacggaccagactcctacgggaggcagcagtagggaatattgggcaatggacgagagtctgacccagccatgccgcgtgcaggaagacggcgttatgcgttgtaaactgcttttatacgggaagaaaaggcccatgcgtgggacattgccggtaccgtatgaataagcaccggctaactccgtgccagcagccgcggtaatacggagggtgcaagcgttgtccggatttattgggtttaaagggtgcgtaggcgggaatttaagtcagcggtgaaagttcagggctcaaccctgaaattgccattgatactggatttcttgagtgtcgatggggtacatggaatttatggtgtagcggtgaaatgcatagataccataaggaacaccgatagcgaaggcattgtacttatcgataactgacgctgaggcacgaaagcgtgggtagcgaacaggattagataccctggtagtccacgccgtaaacgatgattactcgctgttatgcccttgaggtgtagtggccaagcgaaagcgttaagtaatccacctggggagtacgcccgcaagggtgaaactcaaaggaattgacgggggtccgcacaagcggtggagcatgtggtttaattcgatgatacgcgaggaaccttacccgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctattgttagttgccatcaggttaagctggggactctaacaagactgcctgcgcaagcagagaggaaggaggggacgacgtcaagtcatcatggcccttacgcccggggcgacacacgtgctacaatggcgcatacagcgggtagctacctggcaacaggatgccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaagccggtaaccgcaaggagccgtttagggtagaaccggtaactggggctaagtcgtaacaaggtagccgtaccggaaggtgcggctggaacacctcctttct

SEQ ID NO: 1886 - DNA, 1527 bp, Belliella pelovolcani
  ref <308>: DATABASE ACCESSION NUMBER: NCBI ACCESSION: NZ_FTOP01000034.1
  ref <309>: DATABASE ENTRY DATE: 2019-04-01
  ref <313>: RELEVANT RESIDUES IN SEQ ID NO: (1)..(1527)
tttacaatggagagtttgatcctggctcaggatgaacgctagcggcaggcctaatacatgcaagtcgaacgggatctagaagcttgcttttagtgagagtggcgcacgggtgcgtaacgcgtatgcaacctaccttatacagggggatagcccggggaaactcggattaataccccatggtacatttggatggcatcatttaaatgttaaagatttatcggtataagatgggcatgcgtaggattagctagttggtaaggtaacggcttaccaaggcgacgatccttaggggttctgagaggaaggtcccccacactggtactgagatacggaccagactcctacgggaggcagcagtagggaatattgggcaatggtcggaagactgacccagccatgccgcgtgcaggaagacggccttatgggttgtaaactgcttttatcagggaagaaaaaggtcatgcgtgacaaattgccggtacctgatgaataagcaccggctaactccgtgccagcagccgcggtaatacggagggtgcaagcgttgtccggatttattgggtttaaagggtgcgtaggcgggggattaagtcagtggtgaaagtcttgggctcaacccaggaattgccattgatactgattttcttgagtgtcgatggggtacatggaatttatggtgtagcggtgaaatgcatagataccataaggaacaccgatagcgaaggcattgtacttatcgataactgacgctgaggcacgaaagcgtgggtagcgaacaggattagataccctggtagtccacgccgtaaacgatgattactcgctgttatgcctttaaggtgtagtggccaagcgaaagcgttaagtaatccacctggggagtacgccggcaacggtgaaactcaaaggaattgacgggggtccgcacaagcggtggagcatgtggtttaattcgatgatacgcgaggaaccttacccgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctattgttagttgctatcaggttaagctggggactctaacgagactgcctgcgcaagcagagaggaaggaggggacgacgtcaagtcatcatggcccttacgcccggggcgacacacgtgctacaatggcgcatacagcgggtagctacctggcaacaggatgccaacctctaaaagtgcgtctcagttcggatcggggtctgcaactcgaccccgtgaagctggaatcgctagtaatcgcgcatcagccatggcgcggtgaatacgttcccggaccttgtacacaccgcccgtcaagccatggaagtcgggtagacctgaagacagtaaccgcgaggagctgtttagggtagaaccggtaactggggctaagtcgtaacaaggtagccgtaccggaaggtgcggctggaacacctcctttct

SEQ ID NO: 1887 - DNA, 337 bp, Belnapia moabensis
  ref <308>: DATABASE ACCESSION NUMBER: NCBI ACCESSION: NZ_JQKB01000163.1
  ref <309>: DATABASE ENTRY DATE: 2019-04-01
  ref <313>: RELEVANT RESIDUES IN SEQ ID NO: (1)..(337)
atgaacctgagagtttgatcctggctcagagcgaacgctggcggaatgcttaacacatgcaagtcgcacgggggcttcggctctagtggcggacgggtgagtaacgcgtaggaacgtgtcttggggtgggggataacgctgggaaactggcgctaataccgcatgtctgctgcggcagaaagccttcgggtgccttgagagcggcctgcgtccgattagctagttggtggggtaaaggcttaccaaggcttcgatcggtagctggtctgagaggacgatcagccacactgggactgagacacggcccagactcctacgggaggcagcagtggggaat

SEQ ID NO: 1888 - DNA, 1501 bp, Belnapia sp. F-4-1
  ref <308>: DATABASE ACCESSION NUMBER: NCBI ACCESSION: NZ_KN676113.1
  ref <309>: DATABASE ENTRY DATE: 2019-04-01
  ref <313>: RELEVANT RESIDUES IN SEQ ID NO: (1)..(1501)
atgaacctgagagtttgatcctggctcagagcgaacgctggcggaatgcttaacacatgcaagtcgcacgggggcttcggctctagtggcggacgggtgagtaacgcgtaggaacgtgtcttggggtgggggataacgctgggaaactggcgctaataccgcatatctgctgtggcagaaagccttcgggtgccttgagagcggcctgcgtccgattagcttgttggtggggtaatggcttaccaaggcgacgatcggtagctggtctgagaggacgatcagccacactgggactgagacacggcccagactcctacgggaggcagcagtggggaatattggacaatgggcgaaagcctgatccagcaattccgcgtgggtgaagaaggtcttcggattgtaaagccctttcgacagggacgatgatgacggtacctgtagaagaagccccggctaacttcgtgccagcagccgcggtaatacgaagggggctagcgttgctcggaattactgggcgtaaagggcgcgtaggcggcggtgttagtcaggcgtgaaattcctgggctcaacctggggactgcgcttgatacggcattgcttgaggatggaagaggctcgcggaattcccagtgtagaggtgaaattcgtagatattgggaagaacaccggtggcgaaggcggcgagctggtccattactgacgctgaggcgcgacagcgtggggagcaaacaggattagataccctggtagtccacgccgtaaacgatgtgcgctggatgttgggtggcctagccactcagtgtcgtagctaacgcggtaagcgcaccgcctggggagtacggccgcaaggttgaaactcaaaggaattgacgggggcccgcacaagcggtggagcatgtggtttaattcgaagcaacgcgcagaaccttaccagcccttgacatgggcaggatcggcgcagagatgcgctttccccgcaaggggcctgctgcacaggtgctgcatggctgtcgtcagctcgtgtcgtgagatgttgggttaagtcccgcaacgagcgcaaccctcgcctttagttgccatcaggttaggctgggcactctagaggaactgccggtgacaagccggaggaaggtggggatgacgtcaagtcctcatggcccttatgggctgggctacacacgtgctacaatggcggtgacagagggaggccagatggcgacatcgagccgatcccgaaaagccgtctcagttcggattgcactctgcaactcgggtgcatgaaggtggaatcgctagtaatcgcggatcagcacgccgcggtgaatacgttcccgggccttgtacacaccgcccgtcacaccatgggagttggttctaccttaagcaggtgcggcaaccgcaaggggctagcttgccacggtagggtcagtgactggggtgaagtcgtaacaaggtagccgtaggggaacctgcggctggatcacctcctttcaaggaatgt

SEQ ID NO: 1889 - DNA, 205 bp, Bhargavaea beijingensis
  ref <308>: DATABASE ACCESSION NUMBER: NCBI ACCESSION: NZ_FNAR01000029.1
  ref <309>: DATABASE ENTRY DATE: 2019-04-01
  ref <313>: RELEVANT RESIDUES IN SEQ ID NO: (1)..(205)
ctcttatggagagtttgatcctggctcaggacgaacgctggcggcgtgcctaatacatgcaagtcgagcggatgacggggagcttgctcccctgattcagcggcggacgggtgagtaacacgtgggcaacctgcctgtaagatcgggataactccgggaaaccggggctaataccggatggttccttcctccgcatggaggaagg

SEQ ID NO: 1890 - DNA, 1558 bp, Bhargavaea cecembensis
  ref <308>: DATABASE ACCESSION NUMBER: NCBI ACCESSION: NZ_LQNT01000016.1
  ref <309>: DATABASE ENTRY DATE: 2019-04-01
  ref <313>: RELEVANT RESIDUES IN SEQ ID NO: (1)..(1558)
ctctttatggagagtttgatcctggctcaggacgaacgctggcggcgtgcctaatacatgcaagtcgagcggatgacggggagcttgctcccctgattcagcggcggacgggtgagtaacacgtgggcaacctgcctgtaagatcgggataactccgggaaaccggggctaataccggatggttccttcctccgcatggaggaaggcggaaagacggtttcggctgtcacttacagatgggcccgcggcgcattagctagttggtggggtaatggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtaagggaagaacaagcatcggttaactgccggtgccctgacggtaccttaccagaaagccacggctaactacgtgccagcagccgcggtaatacgtaggtggcaagcgttgtccggaatcattgggcgtaaagcgcgcgcaggcggtttcttaagtctgatgtgaaagcccacggctcaaccgtggagggtcattggaaactgggagacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctctgaccaccctggagacagggccttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccacaaaaccgttcccagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 1891 - DNA, 258 bp, Bhargavaea ginsengi
  ref <308>: DATABASE ACCESSION NUMBER: NCBI ACCESSION: NZ_FNZF01000005.1
  ref <309>: DATABASE ENTRY DATE: 2019-04-01
  ref <313>: RELEVANT RESIDUES IN SEQ ID NO: (1)..(258)
ctctttatggagagtttgatcctggctcaggacgaacgctggcggcgtgcctaatacatgcaagtcgagcggatgacggagagcttgctctcctgattcagcggcggacgggtgagtaacacgtgggcaacctgcctgtaagatcgggataactccgggaaaccggggctaataccggatggttccttcctccgcatggaggaaggcggaaagacggtttcggctgtcacttacagatgggcccgcggcgcattagct

SEQ ID NO: 1892 - DNA, 1536 bp, Bifidobacteriaceae bacterium GH005
  ref <308>: DATABASE ACCESSION NUMBER: NCBI ACCESSION: NZ_NQOR01000007.1
  ref <309>: DATABASE ENTRY DATE: 2019-04-01
  ref <313>: RELEVANT RESIDUES IN SEQ ID NO: (1)..(1536)
tttcgtggagggttcgattctggctcaggatgaacgctggcggcgtgcttaacacatgcaagtcgaacgggatctagtcagcttgctgactggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacggag

SEQ ID NO: 1893 - DNA, 1536 bp, Bifidobacteriaceae bacterium NR017; identical to SEQ ID NO: 1892
  ref <308>: DATABASE ACCESSION NUMBER: NCBI ACCESSION: NZ_NNRZ01000012.1
  ref <309>: DATABASE ENTRY DATE: 2019-04-01
  ref <313>: RELEVANT RESIDUES IN SEQ ID NO: (1)..(1536)

SEQ ID NO: 1894 - DNA, 1537 bp, Bifidobacteriaceae bacterium NR019
  ref <308>: DATABASE ACCESSION NUMBER: NCBI ACCESSION: NZ_NNRY01000009.1
  ref <309>: DATABASE ENTRY DATE: 2019-04-01
  ref <313>: RELEVANT RESIDUES IN SEQ ID NO: (1)..(1537)
tttcgtggagggttcgattctggctcaggatgaacgctggcggcgtgcttaacacatgcaagtcgaacgggatctagtcagcttgctgactggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttttgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacggag

SEQ ID NO: 1895 - DNA, 1247 bp, Bifidobacteriaceae bacterium NR020
  ref <308>: DATABASE ACCESSION NUMBER: NCBI ACCESSION: NZ_NNRX01000009.1
  ref <309>: DATABASE ENTRY DATE: 2019-04-01
  ref <313>: RELEVANT RESIDUES IN SEQ ID NO: (1)..(1247)
aatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaagg

SEQ ID NO: 1896 - DNA, 1536 bp, Bifidobacteriaceae bacterium NR021; identical to SEQ ID NO: 1892
  ref <308>: DATABASE ACCESSION NUMBER: NCBI ACCESSION: NZ_NQOP01000004.1
  ref <309>: DATABASE ENTRY DATE: 2019-04-01
  ref <313>: RELEVANT RESIDUES IN SEQ ID NO: (1)..(1536)

SEQ ID NO: 1897 - DNA, 1492 bp, Bifidobacteriaceae bacterium NR026
  ref <308>: DATABASE ACCESSION NUMBER: NCBI ACCESSION: NZ_NQOL01000006.1
  ref <309>: DATABASE ENTRY DATE: 2019-04-01
  ref <313>: RELEVANT RESIDUES IN SEQ ID NO: (1)..(1492)
tttcgtggagggttcgattctggctcaggatgaacgctggcggcgtgcttaacacatgcaagtcgaacgggatctgaccagcttgctggttggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagctttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtttgcgccgggtacgggcgggctagagtgcagtaggggagactggaattctcggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttctgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggt

SEQ ID NO: 1898 - DNA, 1493 bp, Bifidobacteriaceae bacterium NR047
  ref <308>: DATABASE ACCESSION NUMBER: NCBI ACCESSION: NZ_NQOH01000016.1
  ref <309>: DATABASE ENTRY DATE: 2019-04-01
  ref <313>: RELEVANT RESIDUES IN SEQ ID NO: (1)..(1493)
gtgcttaacacatgcaagtcgaacgggatctagtcagcttgctgactggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttttgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgacgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacggag

SEQ ID NO: 1899 - DNA, 1537 bp, Bifidobacteriaceae bacterium VN002
  ref <308>: DATABASE ACCESSION NUMBER: NCBI ACCESSION: NZ_NQOM01000005.1
  ref <309>: DATABASE ENTRY DATE: 2019-04-01
  ref <313>: RELEVANT RESIDUES IN SEQ ID NO: (1)..(1537)
tttcgtggagggttcgattctggctcaggatgaacgctggcggcgtgcttaacacatgcaagtcgaacgggatctgaccagcttgctggttggtgagagtggcgaacgggtgagtaatacgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttttgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtttgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttctgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacggag

SEQ ID NO: 1900 - DNA, 1127 bp, Bifidobacteriaceae bacterium VN003
  ref <308>: DATABASE ACCESSION NUMBER: NCBI ACCESSION: NZ_NNRV01000013.1
  ref <309>: DATABASE ENTRY DATE: 2019-04-01
  ref <313>: RELEVANT RESIDUES IN SEQ ID NO: (1)..(1127)
tttcgtggagggttcgattctggctcaggatgaacgctggcggcgtgcttaacacatgcaagtcgaacgggatctagtcagcttgctgactggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccggg

SEQ ID NO: 1901 - DNA, 1522 bp, Bifidobacteriaceae bacterium WP012
  ref <308>: DATABASE ACCESSION NUMBER: NCBI ACCESSION: NZ_NQOI01000002.1
  ref <309>: DATABASE ENTRY DATE: 2019-04-01
  ref <313>: RELEVANT RESIDUES IN SEQ ID NO: (1)..(1522)
tttcgtggagggttcgattctggctcaggatgaacgctggcggcgtgcttaacacatgcaagtcgaacgggatctagtcagcttgctgactggtgagagtggcgaacgggtgagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagccttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgacagctgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacc

SEQ ID NO: 1902 - DNA, 1425 bp, Bifidobacteriaceae bacterium WP021
  ref <308>: DATABASE ACCESSION NUMBER: NCBI ACCESSION: NZ_NQOO01000011.1
  ref <309>: DATABASE ENTRY DATE: 2019-04-01
  ref <313>: RELEVANT RESIDUES IN SEQ ID NO: (1)..(1425)
gagtaatgcgtgaccaacctgccccatgctccagaatagctcttggaaacgggtggtaatgctggatgctccaacttgacgcatgtcttgttgggaaagtgtttagtggcatgggatggggtcgcgtcctatcagcttgtaggcggggtaatggcccacctaggcttcgacgggtagccggcctgagagggcggacggccacattgggactgagatacggcccagactcctacgggaggcagcagtggggaatattgcgcaatgggggaaaccctgacgcagcgacgccgcgtgcgggatgaaggccttcgggttgtaaaccgcttttgattgggagcaagctttcgggtgagtgtacctttcgaataagcgccggctaactacgtgccagcagccgcggtaatacgtagggcgcaagcgttatccggaattattgggcgtaaagagcttgtaggcggttcgtcgcgtctggtgtgaaagcccatcgcttaacggtgggtctgcgccgggtacgggcgggctagagtgcagtaggggagactggaattcccggtgtaacggtggaatgtgtagatatcgggaagaacaccaatggcgaaggcaggtctctgggctgttactgacgctgagaagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgtgcctgtcgactgcagagatgtggtttcccttcggggcaggttcacaggtggtgcatggtcgtcgtcagctcgtgtcgtgagatgttgggttaagtcccgcaacgagcgcaaccctcgccctgtgttgccagcgggttatgccgggaactcacgggggaccgccggggttaactcggaggaaggtggggatgacgtcagatcatcatgccccttacgtccagggcttcacgcatgctacaatggccggtacaacgggatgcgacatggtgacatggagcggatcccttaaaaccggtctcagttcggatcgtagtctgcaactcgactacgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttttgggatggagccgtctaaggtgaggctcgtgattgggactaagtcgtaacaaggtagccgtaccggaaggtgcggctggatcacctcctttctacggag

SEQ ID NO: 1903 - DNA, 1534 bp, Bifidobacterium aemilianum
  ref <308>: DATABASE ACCESSION NUMBER: NCBI ACCESSION: NZ_PDCG01000008.1
  ref <309>: DATABASE ENTRY DATE: 2019-04-01
  ref <313>: RELEVANT RESIDUES IN SEQ ID NO: (1)..(1534)
ttttgtggagggttcgattctggctcaggatgaacgctggcggcgtgcttaacacatgcaagtcgaacgggatccaggcagcttgctgtctggtgagagtggcgaacgggtgagtaatgcgtgaccaacctgccccatgctccggaatagctcctggaaacgggtggtaatgccggatgttccgcaccatcgcatggtggtgtgggaaggattttatcggcatgggatggggtcgcgtcctatcagcttgttggtggggtagtggcccaccaaggcttcgacgggtagccggcctgagagggtgaccggccacattgggactgagatacggcccagactcctacgggaggcagcagtggggaatattgcacaatgggcgcaagcctgatgcagcgacgccgcgtgcgggatgacggccttcgggttgtaaaccgcttttgattgggagcaagcgagagtgagtgtacctttcgaataagcaccggctaactacgtgccagcagccgcggtaatacgtagggtgcaagcgttatccggaattattgggcgtaaagagctcgtaggcggcttgtcgcgtctggtgtgaaagtccatcgcttaacggtggatctgcgccgggtacgggcaggctagagtgcagtaggggagactggaattcccggtgtaacggtggaatgtgtagatatcgggaagaacaccaatggcgaaggcaggtctctgggctgttactgacgctgaggagcgaaagcgtggggagcgaacaggattagataccctggtagtccacgccgtaaacggtggatgctggatgtggggcccttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcctgacgactgcagagatgtggtttcccttcggggcaggttcacaggtggtgcatggtcgtcgtcagctcgtgtcgtgagatgttgggttaagtcccgcaacgagcgcaaccctcgccttgtgttgccagcgggttatgccgggaactcacaagggaccgccggggttaactcggaggaaggtggggatgacgtcagatcatcatgccccttacgtccagggcttcacgcatgctacaatggccggtacaacgggatgcgacatggcgacatggagcggatcccttaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaaccccttgtgggagggagccgtctaaggtgagactcgtgattgggactaagtcgtaacaaggtagccgtaccggaaggtgcggctggatcacctcctttctacggag

SEQ ID NO: 1904 - DNA, 1537 bp, Bifidobacterium bifidum
  ref <308>: DATABASE ACCESSION NUMBER: NCBI ACCESSION: NZ_LR134344.1
  ref <309>: DATABASE ENTRY DATE: 2019-04-01
  ref <313>: RELEVANT RESIDUES IN SEQ ID NO: (1)..(1537)
ttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatgctccggaatagctcctggaaacgggtggtaatgccggatgttccacatgatcgcatgtgattgtgggaaagattctatcggcgtgggatggggtcgcgtcctatcagcttgttggtgaggtaacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtttgggagcaagccttcgggtgagtgtacctttcgaataagcgccggctaactacgtgccagcagccgcggtaatacgtagggcgcaagcgttatccggatttattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggacgctggatgtggggcacgttccacgtgttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacgccagagatggcgtttcccttcggggcgggttcacaggtggtgcatggtcgtcgtcagctcgtgtcgtgagatgttgggttaagtcccgcaacgagcgcaaccctcgccccgtgttgccagcacgttatggtgggaactcacgggggaccgccggggttaactcggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggag

SEQ ID NO: 1905 - DNA, 1540 bp, Bifidobacterium breve
  ref <308>: DATABASE ACCESSION NUMBER: NCBI ACCESSION: NZ_LR134348.1
  ref <309>: DATABASE ENTRY DATE: 2019-04-01
  ref <313>: RELEVANT RESIDUES IN SEQ ID NO: (1)..(1540)
ttttgtggagggttcgattctggctcaggatgaacgctggcggcgtgcttaacacatgcaagtcgaacgggatccatcgggctttgcctggtggtgagagtggcgaacgggtgagtaatgcgtgaccgacctgccccatgcaccggaatagctcctggaaacgggtggtaatgccggatgctccatcacaccgcatggtgtgttgggaaagcctttgcggcatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgttagggagcaaggcactttgtgttgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgatcccagagatggggtttcccttcggggcgggttcacaggtggtgcatggtcgtcgtcagctcgtgtcgtgagatgttgggttaagtcccgcaacgagcgcaaccctcgccccgtgttgccagcggattgtgccgggaactcacgggggaccgccggggttaactcggaggaaggtggggatgacgtcagatcatcatgccccttacgtccagggcttcacgcatgctacaatggccggtacaacgggatgcgacagtgcgagctggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgcgggagggagccgtctaaggtgaggctcgtgattgggactaagtcgtaacaaggtagccgtaccggaaggtgcggctggatcacctcctttctacggag

SEQ ID NO: 1906 - DNA, 1536 bp, Bifidobacterium callitrichidarum
  ref <308>: DATABASE ACCESSION NUMBER: NCBI ACCESSION: NZ_QFFM01000049.1
  ref <309>: DATABASE ENTRY DATE: 2019-04-01
  ref <313>: RELEVANT RESIDUES IN SEQ ID NO: (1)..(1536)
ttttgtggagggttcgattctggctcaggatgaacgctggcggcgtgcttaacacatgcaagtcgaacgggatccgagcagcttgctgtttggtgagagtggcgaacgggtgagtaatgcgtgaccgacctgccccatgctccggaatagctcctggaaacgggtggtaatgccggatgttccacatgagcgcatgcgattgtgggaaagcttttgcggcgtgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttagcagggagcaagcgttaagtgagtgtacctgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcacgttccacgtgttccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagtggcagagatgtcacctcccttcggggcgggttcacaggtggtgcatggtcgtcgtcagctcgtgtcgtgagatgttgggttaagtcccgcaacgagcgcaaccctcgccccgtgttgccagcatgtaatgatgggaactcacgggggaccgccggggttaactcggaggaaggtggggatgacgtcagatcatcatgccccttacgtccagggcttcacgcatgctacaatggccggtacaacgggatgcgacgacgcgagtcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaacctccttggaggggggagccgtctaaggtgaggctcgtgattgggactaagtcgtaacaaggtagccgtaccggaaggtgcggctggatcacctcctttctacggag

SEQ ID NO: 1907 - DNA, 1529 bp, Bifidobacterium callitrichos
  ref <308>: DATABASE ACCESSION NUMBER: NCBI ACCESSION: NZ_NWTW01000052.1
  ref <309>: DATABASE ENTRY DATE: 2019-04-01
  ref <313>: RELEVANT RESIDUES IN SEQ ID NO: (1)..(1529)
ttttgtggagggttcgattctggctcaggatgaacgctggcggcgtgcttaacacatgcaagtcgaacgggatcccgggtttcggcctgggtgagagtggcgaacgggtgagtaatgcgtgaccgacctgccccgtacaccggaatagctcctggaaacgggtggtaatgccggatgctccagttgatcgcatggtcttctgggaaagattgtatcggtatgggatggggtcgcgtcctatcaggtagtcggcggggtaacggcccaccgagcctatgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgattgggagcaagcgagagtgagtgtacctttcgaataagcaccggctaactacgtgccagcagccgcggtaatacgtagggtgcaagcgttatccggaattattgggcgtaaagagctcgtaggcggttcgtcgcgtctggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggcggcagagatgtcgcttcccttcggggcgggttcacaggtggtgcatggtcgtcgtcagctcgtgtcgtgagatgttgggttaagtcccgcaacgagcgcaaccctcgccccgtgttgccagcatttcggatgggaactcacgggggaccgccggggttaactcggaggaaggtggggatgacgtcagatcatcatgccccttacgtccagggcttcacgcatgctacaatggccggtacaacgggatgcgacaaggcgacttggagcggatccctgaaaaccggtctcagttcggattggagtctgcaacccgactccatgaaggcggagtcgctagtaatcgcgaatcagcaacgtcgcggtgaatgcgttcccgggccttgtacacaccgcccgtcaagtcatgaaagtgggtagcacccgaagccggtggcctaaccgcaaggatggagccgtctaaggtgagactcgtgattgggactaagtcgtaacaaggtagccgtaccggaaggtgcggctggatcacctcctttctacggag

SEQ ID NO: 1908 - DNA, 1536 bp, Bifidobacterium catulorum
  ref <308>: DATABASE ACCESSION NUMBER: NCBI ACCESSION: NZ_QFFN01000023.1
  ref <309>: DATABASE ENTRY DATE: 2019-04-01
  ref <313>: RELEVANT RESIDUES IN SEQ ID NO: (1)..(1536)
ttttgtggagggtttgattctggctcaggacgaacgctggcggcgtgcttaacacatgcaagtcgaacgggatcctgccagcttgctggtgggtgagagtggcgaacgggtgagtaatgcgtgaccgacctgccctgtactgcggaatagctcctggaaacgggtggtaatgccgcatgttccacattgtcgcatggtggtgtgggaaaggtttttccggtatgggatggggtcatgtcctatcagcttgttggtggtgtaagggaccaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgtttgggagcaagcagtgatgtgagtgtacctttcgaataagcgccggctaactacgtgccagcagccgcggtaatacgtagggcgcaagcgttgtccggaattattgggcgtaaagggctcgtaggcggcccgtcgcgtccggtgtgaaagcccatcgcttaacggtgggtctgcgccgggtacgggcgggcttgagtgcggtaggggagaccggaattcccggtgtaacggtggaatgtgtagatatcgggaagaacaccgatggcgaaggcaggtctctgggccgtaactgacgctgaggagcgaaagcgtggggagcgaacaggattagataccctggtagtccacgccgtaaacggtggacgctggatgtggggccctttccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccggcgaccgcagagatgtggtttcccttcggggcgggttcacaggtggtgcatggtcgtcgtcagctcgtgtcgtgagatgttgggttaagtcccgcaacgagcgcaacccttgccctgtgttgccagcgcgtcatggcggggactcacgggggaccgccggggttaactcggaggaaggtggggatgacgtcagatcatcatgccccttacgtccagggcttcacgcatgctacaatggccggtacagcgggatgcgatgcggtgacgcggagcggatccctgaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggcagcacccgaagccggtggcctgacccttgtgggggggagccgtctaaggtgaggctcgtgattgggactaagtcgtaacaaggtagccgtaccggaaggtgcggctggatcacctcctttctacggag

SEQ ID NO: 1909 - DNA, 1539 bp, Bifidobacterium dentium
  ref <308>: DATABASE ACCESSION NUMBER: NCBI ACCESSION: NZ_LR134349.1
  ref <309>: DATABASE ENTRY DATE: 2019-04-01
  ref <313>: RELEVANT RESIDUES IN SEQ ID NO: (1)..(1539)
tttcgtggagggttcgattctggctcaggatgaacgctggcggcgtgcttaacacatgcaagtcgaacgggatcccgggggttcgcctccgggtgagagtggcgaacgggtgagtaatgcgtgaccgacctgccccatacaccggaatagctcctggaaacgggtggtaatgccggatgctccggttggatgcatgtccttccgggaaaggttccatcggtatgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgatcgggagcaagcccttcggggtgagtgtacccttcgaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaagaacaccaatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgtagagatacggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaacccttctgtgggatggagccgtctaaggtgaggctcgtgattgggactaagtcgtaacaaggtagccgtaccggaaggtgcggctggatcacctcctttctacgga

SEQ ID NO: 1910 - DNA, 1534 bp, Bifidobacterium felsineum
  ref <308>: DATABASE ACCESSION NUMBER: NCBI ACCESSION: NZ_PEBJ01000009.1
  ref <309>: DATABASE ENTRY DATE: 2019-04-01
  ref <313>: RELEVANT RESIDUES IN SEQ ID NO: (1)..(1534)
ttttgtggagggttcgattctggctcaggatgaacgctggcggcgtgcttaacacatgcaagtcgaacgggatcccgaagcttgcttcgggtgagagtggcgaacgggtgagtaatgcgtgaccgacctgccccatgctccggaatagctcctggaaacgggtggtaatgccggatgctccagttgatcgcatggtcttctgggaaagctttatgcggcgtgggatggggtcgcgtcctatcagcttgatggcggggtaacggcccaccatggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtcagggagcaagcgagagtgagtgtacctgtcgaataagcgccggctaactacgtgccagcagccgcggtaatacgtagggcgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcacgttccacgtgttccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccatagagatatggtttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacaaggcgacttggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccttttcggaggggggagccgtctaaggtgaggctcgtgattgggactaagtcgtaacaaggtagccgtaccggaaggtgcggctggatcacctcctttctacggag

SEQ ID NO: 1911 - DNA, 1532 bp, Bifidobacterium gallinarum
  ref <308>: DATABASE ACCESSION NUMBER: NCBI ACCESSION: NZ_CP035464.1
  ref <309>: DATABASE ENTRY DATE: 2019-04-01
  ref <313>: RELEVANT RESIDUES IN SEQ ID NO: (1)..(1532)
ttttgtggagggttcgattctggctcaggatgaacgctggcggcgtgcttaacacatgcaagtcgaacgggatccctggcgcttgcgccggggtgagagtggcgaacgggtgagtaatgcgtgaccaacctgccccatgcaccggaatagctcctggaaacgggtggtaatgccggatgctccagatgaccgcatgggattctgggaaagcttttgcggcatgggatggggtcgcgtcctatcagcttgttggtggggtgatggcccaccaaggcttcgacgggtagccggcctgagagggcgaacggccacattgggactgagatacggcccagactcctacgggaggcagcagtggggaatattgcgcaatgggcgaaagcctgacgcagcgacgccgcgtgcgggatggaggccttcgggttgtaaaccgcttttatcggggagcaagcgagagtgagtgtacccgttgaataagcaccggctaactacgtgccagcagccgcggtaatacgtagggtgcaagcgttatccggatttattgggcgtaaagggctcgtaggcggttcgtcgcgtctggtgtgaaagtccatcgcttaacggtggatctgcgccgggtacgggcgggctggagtgcggcaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgacctcagagatggggtttcccttcggggcgggttcacaggtggtgcatggtcgtcgtcagctcgtgtcgtgagatgttgggttaagtcccgcaacgagcgcaaccctcgccccgtgttgccagcgcgtcatggcgggaactcacgggggaccgccggggttaacccggaggaaggcggggatgacgtcagatcatcatgccccttacgtccagggcttcacgcatgctacaatggccggtacaacgggatgcgacatggcgacatggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaacccttgtggggggagccgtctaaggtgaggctcgtgattgggactaagtcgtaacaaggtagccgtaccggaaggtgcggctggatcacctcctttctacggag

SEQ ID NO: 1912 - DNA, 1538 bp, Bifidobacterium hapali
  ref <308>: DATABASE ACCESSION NUMBER: NCBI ACCESSION: NZ_MWWY01000065.1
  ref <309>: DATABASE ENTRY DATE: 2019-04-01
  ref <313>: RELEVANT RESIDUES IN SEQ ID NO: (1)..(1538)
ttttttgtggagggttcgattctggctcaggatgaacgctggcggcgtgcttaacacatgcaagtcgaacgggatcctcgacttcggtttgggtgagagtggcgaacgggtgagtaatgcgtgactgacctgccctgtactttgggatagctcctggaaacgggtggtaatactgaatgttccacatgatcgcatgtgattgtgggaaagcttttttgcggtatgggatggggtcgcgtcctatcagcttgacggtggggtgatggcctaccgtggctttgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttacaagggagcaaggctttttaagttgagtgtactttgtgaataagcaccggctaactacgtgccagcagccgcggtaatacgtagggtgcaagcgttatccggatttattgggcgtaaagagctcgtaggcggttcgtcgcgtctggtgtgaaagcccatcgcttaacggtgggtttgcgccgggtacgggcgggctggagtgcggtaggggagactggaattcccggtgtaacggtggaatgtgtagatatcgggaggaacaccaatggcgaaggcaggtctctgggccgttactgacgctgaggagcgaaagcgtggggagcgaacaggattagataccctggtagtccacgctgtaaacggtggatgctggatgtggggcacgttccacgtgttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacgacctcagagatggggtttcccttcggggtgggttcacaggtggtgcatggtcgtcgtcagctcgtgtcgtgagatgttgggttaagtcccgcaacgagcgcaacccttgccttatgttgccagcagttcggctggggactcataagggaccgccggggttaactcggaggaaggtggggatgacgtcagatcatcatgccccttacgtccagggcttcacgcatgctacaatggctggtacagcgggatgcgatactgtgaggttgagcggatccctgaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggtagcacccgaagccggtggcctaaccgttttggagggagccgtctaaggtgagactcgtgattgggactaagtcgtaacaaggtagccgtaccggaaggtgcggctggatcacctcctttctacggag

SEQ ID NO: 1913 - DNA, 1532 bp, Bifidobacterium imperatoris
  ref <308>: DATABASE ACCESSION NUMBER: NCBI ACCESSION: NZ_NMWV01000059.1
  ref <309>: DATABASE ENTRY DATE: 2019-04-01
  ref <313>: RELEVANT RESIDUES IN SEQ ID NO: (1)..(1532)
ttttgtggagggttcgattctggctcaggatgaacgctggcggcgtgcttaacacatgcaagtcgaacgggatccatcagcttgctggtggtgagagtggcgaacgggtgagtaatgcgtgaccgacctgccccatgctccggaatagctcctggaaacgggtggtaatgccggatgttccagttgatcgcatggtcttctgggaaagctttcgcggcgtgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttgtcagggagcaagcgtgagtgagtgtacctgtcgaataagcgccggctaactacgtgccagcagccgcggtaatacgtagggcgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcacgttccacgtgttccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagcggcggagacgtcgcctcccttcggggcgggttcacaggtggtgcatggtcgtcgtcagctcgtgtcgtgagatgttgggttaagtcccgcaacgagcgcaaccctcgccttatgttgccagcatttcggatgggaactcataagggaccgccggggttaactcggaggaaggtggggatgacgtcagatcatcatgccccttacgtccagggcttcacgcatgctacaatggccggtacaacgggatgcgacaaggcgacttggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaacctcttcggaggggggagccgtctaaggtgaggctcgtgattgggactaagtcgtaacaaggtagccgtaccggaaggtgcggctggatcacctcctttctacggag

SEQ ID NO: 1914 - DNA, 1534 bp, Bifidobacterium longum
  ref <308>: DATABASE ACCESSION NUMBER: NCBI ACCESSION: NZ_LR134369.1
  ref <309>: DATABASE ENTRY DATE: 2019-04-01
  ref <313>: RELEVANT RESIDUES IN SEQ ID NO: (1)..(1534)
ttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatacaccggaatagctcctggaaacgggtggtaatgccggatgttccagttgatcgcatggtcttctgggaaagctttcgcggtatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcggggagcaagcgagagtgagtttacccgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggtcgtagagatacggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacgcggcgacgcggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggag

SEQ ID NO: 1915 - DNA, 1533 bp, Bifidobacterium margollesii
  ref <308>: DATABASE ACCESSION NUMBER: NCBI ACCESSION: NZ_NMWU01000072.1
  ref <309>: DATABASE ENTRY DATE: 2019-04-01
  ref <313>: RELEVANT RESIDUES IN SEQ ID NO: (1)..(1533)
ttttgtggagggttcgattctggctcaggacgaacgctggcggcgtgcttaacacatgcaagtcgaacgggatcctccaagcttgcttgggggtgagagtggcgaacgggtgagtaatgcgtgaccgacctgccccatgctccggaatagctcctggaaacgggtggtaatgccggatgttccagttgatcgcatggtctgctgggaaagatttcatcggcgtgggatggggtcgcgtcctatcagcttgacggcggggtgacggcccaccgtggctttgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgattgggagcaagtgtgagtgagtgtacctttcgaataagcgccggctaactacgtgccagcagccgcggtaatacgtagggcgcaagcgttgtccggaattattgggcgtaaagagctcgtaggcggttcgtcgcgtccggtgtgaaagcccgtcgcttaacggcgggtctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacggcatcagagatggtgcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacagcgggatgcgatgcggtgacgcggagcggatccctgaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggtagcacccgaagccggtggcctaacccttgtggggggagccgtctaaggtgagactcgtgattgggactaagtcgtaacaaggtagccgtaccggaaggtgcggctggatcacctcctttctacggag

SEQ ID NO: 1916 - DNA, 1532 bp, Bifidobacterium mongoliense
  ref <308>: DATABASE ACCESSION NUMBER: NCBI ACCESSION: NZ_QRAJ01000001.1
  ref <309>: DATABASE ENTRY DATE: 2019-04-01
  ref <313>: RELEVANT RESIDUES IN SEQ ID NO: (1)..(1532)
ttttgtggagggttcgattctggctcaggatgaacgctggcggcgtgcttaacacatgcaagtcgaacgggatccgaggcgcttgcgtctcggtgagagtggcgaacgggtgagtaatacgtgactaacctgcctcatacatcggaatagctcctggaaacgggtggtaatgccgaatgctccaaccttccgcatggatggttgggaaagcgttagcggtatgagatggggtcgcgtcctatcagcttgttggtggggtgaaggcccaccaaggcttcgacgggtagccggcctgagagggtgaccggccacattgggactgagatacggcccagactcctacgggaggcagcagtggggaatattgcacaatgggcgaaagcctgatgcagcgacgccgcgtgcgggatgaaggccttcgggttgtaaaccgcttttgattgggagcaagcgagagtgagtgtacctttcgaataagcaccggctaactacgtgccagcagccgcggtaatacgtagggtgcaagcgttatccggaattattgggcgtaaagagctcgtaggcggtttgtcgcgtctggtgtgaaagtccatcgcttaacgatggatctgcgccgggtacgggcaggctagagtgcgacaggggagactggaattcccggtgtaacggtggaatgtgtagatatcgggaagaacaccaatggcgaaggcaggtctctgggtcgtcactgacgctgaggagcgaaagcgtggggagcgaacaggattagataccctggtagtccacgccgtaaacggtggatgctggatgtggggcccattccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcctgacggccgcggagacgcggcttcccttcggggcaggttcacaggtggtgcatggtcgtcgtcagctcgtgtcgtgagatgttgggttaagtcccgcaacgagcgcaaccctcgccttgtgttgccagcacgttatggtgggaactcgcaagggaccgccggggttaactcggaggaaggtggggatgacgtcagatcatcatgccccttacgtccagggcttcacgcatgctacaatggccggtacaacgggatgcgacgcggtgacgcggagcggatcccttaaaaccggtctcagttcggattggagtctgcaactcgactccatgaaggcggagtcgctagtaatcgcgaatcagcaacgtcgcggtgaatgcgttcccgggccttgtacacaccgcccgtcaagtcatgaaagtgggtagcacccgaagccggtggcctaacctttttggggggagccgtctaaggtgagactcgtgattgggactaagtcgtaacaaggtagccgtaccggaaggtgcggctggatcacctcctttctacggag

SEQ ID NO: 1917 - DNA, 1539 bp, Bifidobacterium myosotis
  ref <308>: DATABASE ACCESSION NUMBER: NCBI ACCESSION: NZ_MWWW01000049.1
  ref <309>: DATABASE ENTRY DATE: 2019-04-01
  ref <313>: RELEVANT RESIDUES IN SEQ ID NO: (1)..(1539)
gtttttttgtggagggttcgattctggctcaggatgaacgctggcggcgtgcttaacacatgcaagtcgaacgggatccctggtttcggccggggtgagagtggcgaacgggtgagtaatgcgtgaccgacctgccctgtactgcggaatagctcctggaaacgggtggtaatgccgcatgctccaatgcactgcatggtgtgttgggaaaggtttttccggtatgggatggggtcgcgtcctatcaggtagtcggcggggtgatggcccaccgagcctatgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttatcggggagcaagcgatgagtgagtgtacccgttgaataagcaccggctaactacgtgccagcagccgcggtaatacgtagggtgcaagcgttatccggaattattgggcgtaaagagctcgtaggcggttcgtcgcgtctggtgtgaaagcccatcgcttaacggtgggtctgcgccgggtacgggcgggctggagtgcggtaggggagactggaattcccggtgtaacggtggaatgtgtagatatcgggaggaacaccaatggcgaaggcaggtctctgggccgttactgacgctgaggagcgaaagcgtggggagcgaacaggattagataccctggtagtccacgccgtaaacggtggatgctggatgtggggcacgttccacgtgttccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccggcgacggcagagatgtcgtttcccttcggggcgggttcacaggtggtgcatggtcgtcgtcagctcgtgtcgtgagatgttgggttaagtcccgcaacgagcgcaaccctcgccttgtgttgccagcggttcggccgggaactcacaagggaccgccggggtcaactcggaggaaggtggggatgacgtcagatcatcatgccccttacgtccagggcttcacgcatgctacaatggccggtacaacgggatgcgacactgtgaggtggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggtagcacccgaagccggtggcctaaccttttcgtaaggggggagccgtctaaggtgagactcgtgattgggactaagtcgtaacaaggtagccgtaccggaaggtgcggctggatcacctcctttctacggag

SEQ ID NO: 1918 - DNA, 1543 bp, Bifidobacterium parmae
  ref <308>: DATABASE ACCESSION NUMBER: NCBI ACCESSION: NZ_NMWT01000044.1
  ref <309>: DATABASE ENTRY DATE: 2019-04-01
  ref <313>: RELEVANT RESIDUES IN SEQ ID NO: (1)..(1543)
ttttgtggagggttcgattctggctcaggatgaacgctggcggcgtgcttaacacatgcaagtcgaacgggatcctgggggctttgcttccgggtgagagtggcgaacgggtgagtaatgcgtgaccgacctgccccgtactccggaatagctcctggaaacgggtggtaatgccggatgttccgcactgtcgcatggtggtgtgggaaagggtcttaccggtacgggatggggtcgcgtcctatcagcttgacggtgcggtgacggcgcaccgtggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttggcagggagcaaggccttcgggttgagtgtacctgcagaataagcaccggctaactacgtgccagcagccgcggtaatacgtagggtgcaagcgttatccggaattattgggcgtaaagggctcgtaggcggttcgtcgcgtccggtgtgaaagcccatcgcttaacggtgggtctgcgccgggtacgggcgggctggagtgcggtaggggagactggaattcccggtgtaacggtggaatgtgtagatatcgggaggaacaccaatggcgaaggcaggtctctgggccgttactgacgctgaggagcgaaagcgtggggagcgaacaggattagataccctggtagtccacgccgtaaacggtggatgctggatgtggggccctttccacgggtcccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgaccgccgtggagacgcggcttcccttcggggcgggttcacaggtggtgcatggtcgtcgtcagctcgtgtcgtgagatgttgggttaagtcccgcaacgagcgcaaccctcgccccgtgttgccagcagttcggctggggactcacgggggaccgccggggtcaactcggaggaaggtggggatgacgtcagatcatcatgccccttacgtccagggcttcacgcatgctacaatggccggtacagcgggatgcgacatggcgacatggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggcagcacccgaagccggtggcctaacctcccttgggagggtggagccgtctaaggtgaggctcgtgattgggactaagtcgtaacaaggtagccgtaccggaaggtgcggctggatcacctcctttctacggag

SEQ ID NO: 1919 - DNA, 1538 bp, Bifidobacterium primatium
  ref <308>: DATABASE ACCESSION NUMBER: NCBI ACCESSION: NZ_PEBI01000007.1
  ref <309>: DATABASE ENTRY DATE: 2019-04-01
  ref <313>: RELEVANT RESIDUES IN SEQ ID NO: (1)..(1538)
ttttgtggagggtttgattctggctcaggacgaacgctggcggcgtgcttaacacatgcaagtcgaacgggatccatcaggctttgcctggtggtgagagtggcgaacgggtgagtaatgcgtgaccgacctgccccgtacttcggaatagctcctggaaacgggtggtaatgccggatgctccaacatgctgcatggtgtgttgggaaagggttttgtaccggtatgggatggggtcgcgtcctatcagcttgttggtgaggtgacggctcaccaaggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgattgggagcaagcggaagtgagtgtacctttcgaataagcgccggctaactacgtgccagcagccgcggtaatacgtagggcgcaagcgttgtccggaattattgggcgtaaagggctcgtaggcggcccgtcgcgtccggtgtgaaagcccgtcgcttaacgtcgggtctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggccctttccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgaccgcagagatgtggtttcccttcggggcgggttcacaggtggtgcatggtcgtcgtcagctcgtgtcgtgagatgttgggttaagtcccgcaacgagcgcaacccttgccctgtgttgccagcgcgtcatggcggggactcacgggggaccgccggggttaactcggaggaaggtggggatgacgtcagatcatcatgccccttacgtccagggcttcacgcatgctacaatggccggtacagcgggatgcgatggcgcgagccggagcggatccctgaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggcagcacccgaagccggtggcctaacccgcaagggatggagccgtctaaggtgaggctcgtgattgggactaagtcgtaacaaggtagccgtaccggaaggtgcggctggatcacctcctttctacggag

SEQ ID NO: 1920 - DNA, 1536 bp, Bifidobacterium pseudocatenulatum
  ref <308>: DATABASE ACCESSION NUMBER: NCBI ACCESSION: NZ_RCXS01000006.1
  ref <309>: DATABASE ENTRY DATE: 2019-04-01
  ref <313>: RELEVANT RESIDUES IN SEQ ID NO: (1)..(1536)
ttttgtggagggttcgattctggctcaggatgaacgctggcggcgtgcttaacacatgcaagtcgaacgggatccatcaggctttgcttggtggtgagagtggcgaacgggtgagtaatgcgtgaccgacctgccccatacaccggaatagctcctggaaacgggtggtaatgccggatgctccgactcctcgcatggggtgtcgggaaagattcatcggtatgggatggggtcgcgtcctatcaggtagtcggcggggtaacggcccaccgagcctacgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgatcgggagcaagccttcgggtgagtgtacctttcgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagccgtagagatatggcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggtcaactcggaggaaggtggggatgacgtcagatcatcatgccccttacgtccagggcttcacgcatgctacaatggccggtacaacgggatgcgacacggcgacgtggagcggatccctgaaaaccggtctcagttcggattggagtctgcaacccgactccatgaaggcggagtcgctagtaatcgcggatcagcaacgccgcggtgaatgcgttcccgggccttgtacacaccgcccgtcaagtcatgaaagtgggtagcacccgaagccggtggcctaaccctttgtggatggagccgtctaaggtgagactcgtgattgggactaagtcgtaacaaggtagccgtaccggaaggtgcggctggatcacctcctttctacggag

SEQ ID NO: 1921 - DNA, 1548 bp, Bifidobacterium pseudolongum
  ref <308>: DATABASE ACCESSION NUMBER: NCBI ACCESSION: NZ_RYVC01000020.1
  ref <309>: DATABASE ENTRY DATE: 2019-04-01
  ref <313>: RELEVANT RESIDUES IN SEQ ID NO: (1)..(1548)
ttttgtggagggttcgattctggctcaggatgaacgctggcggcgtgcttaacacatgcaagtcgaacgggatccctggcagcttgctgccggggtgagagtggcgaacgggtgagtaatgcgtgaccgacctgccccatgcaccggaatagctcctggaaacgggtggtaatgccggatgttccacatgagcgcatgcgagtgtgggaaaggctttttgcggcatgggatggggtcgcgtcctatcagcttgttggtggggtaacggcctaccaaggcgttgacgggtagccggcctgagagggcgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcacggtttcggccgtgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttttccgggtcctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggacgcccgcggagacgtgggttcccttcggggccggttcacaggtggtgcatggtcgtcgtcagctcgtgtcgtgagatgttgggttaagtcccgcaacgagcgcaaccctcgccgcgtgttgccagcgggtcatgccgggaactcacgtgggaccgccggggttaactcggaggaaggtggggatgacgtcagatcatcatgccccttacgtccagggcttcacgcatgctacaatggccggtacaacggggtgcgacacggtgacgtggggcggatccctgaaaaccggtctcagttcggatcgcagtctgcaactcgactgcgtgaaggtggagtcgctagtaatcgcggatcagcaacgccgcggtgaatgcgttcccgggccttgtacacaccgcccgtcaagtcatgaaagtgggcagcacccgaagacggtggcctaaccttattggggggagccgtctaaggtgaggctcgtgattgggactaagtcgtaacaaggtagccgtaccggaaggtgcggctggatcacctcctttctacggag

SEQ ID NO: 1922 - DNA, 1536 bp, Bifidobacterium scaligerum
  ref <308>: DATABASE ACCESSION NUMBER: NCBI ACCESSION: NZ_PGLQ01000004.1
  ref <309>: DATABASE ENTRY DATE: 2019-04-01
  ref <313>: RELEVANT RESIDUES IN SEQ ID NO: (1)..(1536)
ttttgtggagggttcgattctggctcaggatgaacgctggcggcgtgcttaacacatgcaagtcgaacgggatccatcaagcttgcttggtggtgagagtggcgaacgggtgagtaatgcgtgaccgacctgccccatgcaccggaatagctcctggaaacgggtggtaatgccggatgctccacactgctgcatggcggtgtgggaaagcttttgcggcatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttagcagggagcaagcgttaagtgagtgtacctgttgaataagcaccggctaactacgtgccagcagccgcggtaatacgtagggtgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggcacgttccacgtgttccgtgtcggagccaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacagtggcagagatgtcacctcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacaacgggatgcgacaaggcgacttggagcggatccctgaaaaccggtctcagttcggatcgcagtctgcaactcgactgcgtgaaggcggagtcgctagtaatcgcgaatcagcaacgtcgcggtgaatgcgttcccgggccttgtacacaccgcccgtcaagtcatgaaagtgggcagcacccgaagccggtggcctaacctcttcggaggggggagccgtctaaggtgaggctcgtgattgggactaagtcgtaacaaggtagccgtaccggaaggtgcggctggatcacctcctttctacggag

SEQ ID NO: 1923 - DNA, 913 bp, Bifidobacterium simiarum
  ref <308>: DATABASE ACCESSION NUMBER: NCBI ACCESSION: NZ_PEBK01000021.1
  ref <309>: DATABASE ENTRY DATE: 2019-04-01
  ref <313>: RELEVANT RESIDUES IN SEQ ID NO: (1)..(913)
tgggaaagggtcttaccggtatgggatggggtcgcgtcctatcagcttgtcggtggggtaacggcccaccgaggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgattgggagcaagcgcaagtgagtgtacctttcgaataagcgccggctaactacgtgccagcagccgcggtaatacgtagggcgcaagcgttgtccggaattattgggcgtaaagggctcgtaggcggcccgtcgcgtccggtgtgaaagcccgtcgcttaacggcgggtctgcgccgggtacgggcgggctggagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgactccggagacggggtttcccttcggggcgggttcacaggtggtgcatggtcgtcgtcagctcgtgtcgtgagatgttgggttaagtcccgcaacgagcgcaaccctcgccccgtgttgccagcac

SEQ ID NO: 1924 - DNA, 1551 bp, Bifidobacterium sp. 2020B
  ref <308>: DATABASE ACCESSION NUMBER: NCBI ACCESSION: NZ_QXGI01000017.1
  ref <309>: DATABASE ENTRY DATE: 2019-04-01
  ref <313>: RELEVANT RESIDUES IN SEQ ID NO: (1)..(1551)
ttttgtggagggttcgattctggctcaggatgaacgctggcggcgtgcttaacacatgcaagtcgaacgggatccctggcagcttgctgccggggtgagagtggcgaacgggtgagtaatgcgtgaccaacctgccccatgcaccggaatagctcctggaaacgggtggtaatgccggatgctccgcgccctccgcatgggggtgtgggaaatgcttttgcggcatgggatggggtcgcgtcctatcagcttgttggcggggtgacggcccaccaaggcgttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgttcaagggcaaggcaggtcttcgggcctgttgagtggattgttcgaataagcaccggctaactacgtgccagcagccgcggtaatacgtagggtgcaagcgttatccggatttattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgcctgacgatcccggaaacggggtttcccttcggggcgggttcacaggtggtgcatggtcgtcgtcagctcgtgtcgtgagatgttgggttaagtcccgcaacgagcgcaaccctcgccgcatgttgccagcgggttatgccgggaactcatgcgggaccgccggggtcaactcggaggaaggtggggatgacgtcagatcatcatgccccttacgtccagggcttcacgcatgctacaatggccggtacaacgcgatgcgacatggtgacatggggcggatcgctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggcagcacccgaagccggtggcccaaccgcttttgcggggggagccgtctaaggtgaggctcgtgattgggactaagtcgtaacaaggtagccgtaccggaaggtgcggctggatcacctcctttctacggag

SEQ ID NO: 1925 - DNA, 1535 bp, Bifidobacterium sp. 2028B
  ref <308>: DATABASE ACCESSION NUMBER: NCBI ACCESSION: NZ_QXGJ01000026.1
  ref <309>: DATABASE ENTRY DATE: 2019-04-01
  ref <313>: RELEVANT RESIDUES IN SEQ ID NO: (1)..(1535)
ttttgtggagggtttgattctggctcaggacgaacgctggcggcgtgcttaacacatgcaagtcgaacgggatcctgtcagcttgctggcgggtgagagtggcgaacgggtgagtaatgcgtgaccaacctgccccgtactccggaatagctcctggaaacgggtggtaatgccggatgttccgcgctcctgcatgggggtgtgggaaagggttttactggtatgggatggggtcgcgtcctatcagcttgatggtggggtaatggcctaccatggcttcgacgggtagccggcctgagagggcgaccggccacattgggactgagatacggcccagactcctacgggaggcagcagtggggaatattgcacaatgggcgaaagcctgatgcagcgacgccgcgtgcgggatgacggccttcgggttgtaaaccgcttttgattgggagcaagcgtgagtgagtgtacctttcgaataagcgccggctaactacgtgccagcagccgcggtaatacgtagggcgcaagcgttgtccggaattattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaggaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgaccgccgcagagatgtggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacagcgggatgcgatggtgtgagccggagcggatccctgaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggcagcacccgaagccggtggcctaacccgcaagggatggagccgtctaaggtgaggctcgtgattgggactaagtcgtaacaaggtagccgtaccggaaggtgcggctggatcacctcctttctacggag

SEQ ID NO: 1926 - DNA, 1536 bp, Bifidobacterium sp. 2033B
  ref <308>: DATABASE ACCESSION NUMBER: NCBI ACCESSION: NZ_QXGK01000038.1
  ref <309>: DATABASE ENTRY DATE: 2019-04-01
  ref <313>: RELEVANT RESIDUES IN SEQ ID NO: (1)..(1536)
ttttgtggagggttcgattctggctcaggatgaacgctggcggcgtgcttaacacatgcaagtcgaacgggatccgaccagcttgctggttggtgagagtggcgaacgggtgagtaatgcgtgaccaacctgccccatgcaccggaatagctcctggaaacgggtggtaatgccggatgctccacatgacctcatgggattgtgggaaagatttcatcggcatgggatggggtcgcgtcctatcagcttgacggcggggtaacggcccaccgtggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgtcagggagcaagcgagagtgagtgtacctgtcgaataagcgccggctaactacgtgccagcagccgcggtaatacgtagggcgcaagcgttatccggaattattgggcgtaaagggctcgtaggcggttcgtcgcgtccggtgtgaaagtccatcgcttaacggtggatccgcgccgggtacgggcgggcttgagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggccctttccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacagcggcagagatgtcgcctcccttcggggcgggttcacaggtggtgcatggtcgtcgtcagctcgtgtcgtgagatgttgggttaagtcccgcaacgagcgcaaccctcgccctgtgttgccagcacgtcatggtgggaactcacgggggaccgccggggttaactcggaggaaggtggggatgacgtcagatcatcatgccccttacgtccagggcttcacgcatgctacaatggccggtacagcgggatgcgacatggtgacatggagcggatccctgaaaaccggtctcagttcggatcgcagtctgcaactcgactgcgtgaaggcggagtcgctagtaatcgcggatcagcaacgccgcggtgaatgcgttcccgggccttgtacacaccgcccgtcaagtcatgaaagtgggcagcacccgaagccggtggcctaaccagttttctggggggagccgtctaaggtgaggctcgtgattgggactaagtcgtaacaaggtagccgtaccggaaggtgcggctggatcacctcctttctacggag

SEQ ID NO: 1927 - DNA, 1533 bp, Bifidobacterium sp. 2034B
  ref <308>: DATABASE ACCESSION NUMBER: NCBI ACCESSION: NZ_QXGL01000019.1
  ref <309>: DATABASE ENTRY DATE: 2019-04-01
  ref <313>: RELEVANT RESIDUES IN SEQ ID NO: (1)..(1533)
ttttgtggagggttcgattctggctcaggatgaacgctggcggcgtgcttaacacatgcaagtcgaacgggatcccgaagcttgctttgggtgagagtggcgaacgggtgagtaatgcgtgaccgacctgccctgtactctggaatagctcctggaaacgggtggtaatgccggatgttccacatgagtgcatgcgattgtgggaaagattttatcggtatgggatggggtcgcgtcctatcagcttgttggtggggtaatggcctaccaaggcttcgacgggtagccggcctgagagggcgaccggccacattgggactgagatacggcccagactcctacgggaggcagcagtggggaatattgcacaatgggcgcaagcctgatgcagcgacgccgcgtgagggatggaggccttcgggttgtaaacctcttttatcagggagcaagcgtaagtgagtttacctgttgaataagcaccggctaactacgtgccagcagccgcggtaatacgtagggtgcaagcgttatccggaattattgggcgtaaagagctcgtaggcggttcgtcgcgtctggtgtgaaagtccatcgcttaacggtggatctgcgccgggtacgggcgggctagagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgacgacatcagagatggtgtttcccttcggggcgggttcacaggtggtgcatggtcgtcgtcagctcgtgtcgtgagatgttgggttaagtcccgcaacgagcgcaaccctcgccccgtgttgccagcatgtaatgatgggaactcacgggggaccgccggggttaactcggaggaaggtggggatgacgtcagatcatcatgccccttacgtccagggcttcacgcatgctacaatggccggtacagcgggatgcgacatagtgatatggagcggatccctgaaaaccggtctcagttcggattggagtctgcaactcgactccatgaaggcggagtcgctagtaatcgcggatcagcaacgccgcggtgaatgcgttcccgggccttgtacacaccgcccgtcaagtcatgaaagtgggcagcacccgaagccggtggcctaacctctttgaggatggagccgtctaaggtgaggctcgtgattgggactaagtcgtaacaaggtagccgtaccggaaggtgcggctggatcacctcctttctacggag

SEQ ID NO: 1928 - DNA, 1544 bp, Bifidobacterium sp. 2036B
  ref <308>: DATABASE ACCESSION NUMBER: NCBI ACCESSION: NZ_QXGM01000005.1
  ref <309>: DATABASE ENTRY DATE: 2019-04-01
  ref <313>: RELEVANT RESIDUES IN SEQ ID NO: (1)..(1544)
ttttgtggagggttcgattctggctcaggatgaacgctggcggcgtgcttaacacatgcaagtcgaacgggatctgatcaagcttgcttgattggtgagagtggcgaacgggtgagtaatgcgtgactaacctgccttgtgcaccggaatagctcctggaaacgggtggtaataccggatgttccgcttcttcgcatgaagttgtgggaaatgcttttgcggcatgagatggggtcgcgtcctatcagcttgttggcggggtgatggcccaccaaggctttgacgggtagccggcctgagagggtgaccggccacattgggactgagatacggcccagactcctacgggaggcagcagtggggaatattgcacaatgggcgcaagcctgatgcagcgacgccgcgtgcgggatggaggccttcgggttgtaaaccgcttttgattgtcagcaaggcattctttggaatgttgagtgtagctttcgaataagcaccggctaactacgtgccagcagccgcggtaatacgtagggtgcaagcgttatccggatttattgggcgtaaagggctcgtaggcggttcgtcgcgtctggtgtgaaagtccatcgcttaacggtggatttgcgccgggtacgggcggactagagtgcggtaggggagactggaattcccggtgtaacggtggaatgtgtagatatcgggaagaacaccaatggcgaaggcaggtctctgggccgttactgacgctgaggagcgaaagcgtggggagcgaacaggattagataccctggtagtccacgccgtaaacggtggatgctggatgtggggccctttccacgggttctgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttccggatcgcctcagagatggggtttcccttcggggccggttcacaggtggtgcatggtcgtcgtcagctcgtgtcgtgagatgttgggttaagtcccgcaacgagcgcaaccctcgccgcgtgttgccagcacattatggtgggaactcacgtgggaccgccggggttaactcggaggaaggtggggatgacgtcagatcatcatgccccttacgtccagggcttcacgcatgctacaatggccggtacaacgggatgcgacactgtgaggtggagcggatccctgaaaaccggtctcagttcggattgcagtctgcaactcgactgcatgaaggcggagtcgctagtaatcgcagatcagcaacgctgcggtgaatgcgttcccgggccttgtacacaccgcccgtcaagtcatgaaagtgggtagcacccgaagccggtggcctgaccttttggagggagccgtctaaggtgagactcgtgattgggactaagtcgtaacaaggtagccgtaccggaaggtgcggctggatcacctcctttctacggag

SEQ ID NO: 1929 - DNA, 1534 bp, Bifidobacterium sp. wkB338
  ref <308>: DATABASE ACCESSION NUMBER: NCBI ACCESSION: NZ_NPOR01000014.1
  ref <309>: DATABASE ENTRY DATE: 2019-04-01
  ref <313>: RELEVANT RESIDUES IN SEQ ID NO: (1)..(1534)
ttttgtggagggtttgattctggctcaggatgaacgctggcggcgtgcttaacacatgcaagtcgaacgggatccgccaagcttgcttggtggtgagagtggcgaacgggtgagtaatgcgtgaccaacctgccccatgcttcggaatagctcctggaaacgggtggtaatgccggatgctccgcatcatcgcatgatggtgtgggaaagggtttaccggcatgggatggggtcgcgtcctatcagcttgttggcggggtgatggcctgccaaggcttcgacgggtagccggcctgagagggcgaccggccacattgggactgagatacggcccagactcctacgggaggcagcagtggggaatattgcacaatgggcgcaagcctgatgcagcgacgccgcgtgcgggatgacggccttcgggttgtaaaccgcttttgattgggagcaagcgagagtgagtgtacctttcgaataagcaccggctaactacgtgccagcagccgcggtaatacgtagggtgcaagcgttatccggatttattgggcgtaaagagctcgtaggcggttcgtcgcgtctggtgtgaaagtccatcgcttaacggtggatcggcgccgggtacgggcggactggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggacggccgcggagacgcggcttcccttcggggccggttcacaggtggtgcatggtcgtcgtcagctcgtgtcgtgagatgttgggtcaagtcccgcaacgagcgcaaccctcgcctcgtgttgccagcgggtcatgccgggaactcacgggggaccgccggggttaacccggaggaaggtggggatgacgtcagatcatcatgccccttacgtccagggcttcacgcatgctacaatggccggtacaacgggatgcgacatggtgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcccaacccgtttgggggggagccgtctaaggtgaggtccgcgattgggactaagtcgtaacaaggtagccgtaccggaaggtgcggctggatcacctcctttctacggag

SEQ ID NO: 1930 - DNA, 1502 bp, Bifidobacterium sp. wkB344
  ref <308>: DATABASE ACCESSION NUMBER: NCBI ACCESSION: NZ_NPOQ01000024.1
  ref <309>: DATABASE ENTRY DATE: 2019-04-01
  ref <313>: RELEVANT RESIDUES IN SEQ ID NO: (1)..(1502)
ttttgtggagggtttgattctggctcaggatgaacgctggcggcgtgcttaacacatgcaagtcgaacgggatccaggcagcttgctgtctggtgagagtggcgaacgggtgagtaatgcgtgaccaacctgccccatgcttcggaatagctcctggaaacgggtggtaatgccggatgctccgcatcatcgcatgatggtgtgggaaagggtttaccggcatgggatggggtcgcgtcctatcagcttgttggcggggtgatggcctgccaaggcttcgacgggtagccggcctgagagggcgaccggccacattgggactgagatacggcccagactcctacgggaggcagcagtggggaatattgcacaatgggcgaaagcctgatgcagcgacgccgcgtgcgggatgacggccttcgggttgtaaaccgcttttgattgggagcaagcgagagtgagtgtacctttcgaataagcaccggctaactacgtgccagcagccgcggtaatacgtagggtgcaagcgttatccggatttattgggcgtaaagagctcgtaggcggttcgtcgcgtctggtgtgaaagtccatcgcttaacggtggatcggcgccgggtacgggcggactggagtgcggtaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggatgctggatgtggggcccgttccacgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgtgccggacggccgcggagacgcggtttcccttcggggccggttcacaggtggtgcatggtcgtcgtcagctcgtgtcgtgagatgttgggtcaagtcccgcaacgagcgcaaccctcgcctcgtgttgccagcacgttatggtgggaactcacgggggaccgccggggttaacccggaggaaggtggggatgacgtcagatcatcatgccccttacgtccagggcttcacgcatgctacaatggccggtacaacgggatgcgacatggtgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggcagcacccgaagccggtggcccaacccgtttgggggggagccgtctaaggtgaggtccgcgattgggactaagtcgtaacaaggtagccgtaccgga

SEQ ID NO: 1931 - DNA, 1537 bp, Bifidobacterium tissieri
  ref <308>: DATABASE ACCESSION NUMBER: NCBI ACCESSION: NZ_MWWV01000031.1
  ref <309>: DATABASE ENTRY DATE: 2019-04-01
  ref <313>: RELEVANT RESIDUES IN SEQ ID NO: (1)..(1537)
tttttgtggagggtttgattctggctcaggacgaacgctggcggcgtgcttaacacatgcaagtcgaacgggatccatcaagcttgcttggtggtgagagtggcgaacgggtgagtaatgcgtgaccaacctgccctgtactctggaatagctcctggaaacgggtggtaatgccggatgctccacatgggtgcatgcctgtgtgggaaagggtttaccggtatgggatggggtcgcgtcctatcagcttgacggcggggtaatggcccaccgtggctttgacgggtagccggcctgagagggcgaccggccacattgggactgagatacggcccagactcctacgggaggcagcagtggggaatattgcacaatggggggaaccctgatgcagcgacgccgcgtgcgggatgacggccttcgggttgtaaaccgcttttgattgggagcaagcgttaagtgagtgtacctttcgaataagcgccggctaactacgtgccagcagccgcggtaatacgtagggcgcaagcgttgtccggaattattgggcgtaaagggctcgtaggcggctcgtcgcgtctggtgtgaaagtccatcgcttaacggtggatctgcgccgggtacgggcgggctggagtgcggtaggggagactggaattcccggtgtaacggtggaatgtgtagatatcgggaggaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccggcgacatcagagatggtgtttcccttcggggcgggttcacaggtggtgcatggtcgtcgtcagctcgtgtcgtgagatgttgggttaagtcccgcaacgagcgcaaccctcgccccgtgttgccagcacgtcatggtgggaactcacgggggaccgccggggttaactcggaggaaggtggggatgacgtcagatcatcatgccccttacgtccagggcttcacgcatgctacaatggccggtacagcgggatgcgatgcggtgacgcggagcggatccctgaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggcagcacccgaagccggtggcctaaccccttgtgggatggagccgtctaaggtgaggctcgtgattgggactaagtcgtaacaaggtagccgtaccggaaggtgcggctggatcacctcctttctacggag

SEQ ID NO: 1932 - DNA, 1536 bp, Bifidobacterium vansinderenii
  ref <308>: DATABASE ACCESSION NUMBER: NCBI ACCESSION: NZ_NEWD01000058.1
  ref <309>: DATABASE ENTRY DATE: 2019-04-01
  ref <313>: RELEVANT RESIDUES IN SEQ ID NO: (1)..(1536)
tttttgtggagggtttgattctggctcaggacgaacgctggcggcgtgcttaacacatgcaagtcgaacgggatcctgccagcttgctggcgggtgagagtggcgaacgggtgagtaatgcgtgaccaacctgccccgtactccggaatagctcctggaaacgggtggtaatgccggatgctccgcgcctctgcatgggggtgtgggaaagggttttactggtatgggatggggtcgcgtcctatcagcttgatggtggggtaatggcccaccatggcttcgacgggtagccggcctgagagggcgaccggccacattgggactgagatacggcccagactcctacgggaggcagcagtggggaatattgcacaatgggcgaaagcctgatgcagcgacgccgcgtgcgggatgacggccttcgggttgtaaaccgcttttgattgggagcaagcgagagtgagtgtacctttcgaataagcgccggctaactacgtgccagcagccgcggtaatacgtagggcgcaagcgttgtccggaattattgggcgtaaagggctcgtaggcggctcgtcgcgtccggtgtgaaagtccatcgcttaacggtggatctgcgccgggtacgggcgggctggagtgcggtaggggagactggaattcccggtgtaacggtggaatgtgtagatatcgggaggaacaccaatggcgaaggcaggtctctgggccgttactgacgctgaggagcgaaagcgtggggagcgaacaggattagataccctggtagtccacgccgtaaacggtggacgctggatgtggggcccattccacgggttccgtgtcggagctaacgcgttaagcgtcccgcctggggagtacggccgcaaggctaaaactcaaagaaattgacgggggcccgcacaagcggcggagcatgcggattaattcgatgcaacgcgaagaaccttacctgggcttgacatgttcccgaccgccgcagagatgtggcttcccttcggggcgggttcacaggtggtgcatggtcgtcgtcagctcgtgtcgtgagatgttgggttaagtcccgcaacgagcgcaaccctcgccccgtgttgccagcggattatgccgggaactcacgggggaccgccggggttaactcggaggaaggtggggatgacgtcagatcatcatgccccttacgtccagggcttcacgcatgctacaatggccggtacagcgggatgcgatggtgcgagccggagcggatccctgaaaaccggtctcagttcggatcggagcctgcaactcggctccgtgaaggtggagtcgctagtaatcgcggatcagcaacgccgcggtgaatgcgttcccgggccttgtacacaccgcccgtcaagtcatgaaagtgggcagcacccgaagccggtggcctaacccgcaagggatggagccgtctaaggtgaggctcgtgattgggactaagtcgtaacaaggtagccgtaccggaaggtgcggctggatcacctcctttctacggag

SEQ ID NO: 1933 - DNA, 1538 bp, Bifidobacterium xylocopae
  ref <308>: DATABASE ACCESSION NUMBER: NCBI ACCESSION: NZ_PDCH01000003.1
  ref <309>: DATABASE ENTRY DATE: 2019-04-01
  ref <313>: RELEVANT RESIDUES IN SEQ ID NO: (1)..(1538)
ttttgtggagggttcgattctggctcaggatgaacgctggcggcgtgcttaacacatgcaagtcgaacgggatccaagcagcttgctgtttggtgagagtggcgaacgggtgagtaatgcgtgaccgacctgccccatgctccggaatagctcctggaaacgggtggtaatgccggatgttccgcatcatcgcatggtggtgtgggaaagatttatcggcatgggatggggtcgcgtcctatcagcttgttggtggggtaacggcccaccaaggcttcgacgggtagccggcctgagagggtgaccggccacattgggactgagatacggcccagactcctacgggaggcagcagtggggaatattgcacaatgggcgcaagcctgatgcagcgacgccgcgtgcgggatgacggccttcgggttgtaaaccgcttttagcagggggcaagccttcgggtgagtgtacctgttgaataagcgccggctaactacgtgccagcagccgcggtaatacgtagggcgcaagcgttatccggatttattgggcgtaaagggctcgtaggcggcttgtcgcgtccggtgtgaaagtccactgcttaacggtggatcggcgccgggtacgggcaggctggagtgcggcaggggagactggaattcccggtgtaacggtggaatgtgtagatatcgggaagaacaccgatggcgaaggcaggtctctgggccgtcactgacgctgaggagcgaaagcgtggggagcgaacaggattagataccctggtagtccacgccgtaaacggtggatgctggatgtggggcccgttccgcgggttccgtgtcggagctaacgcgttaagcatcccgcctggggagtacggccgcaaggctaaaactcaaagaaattgacgggggcccgcacaagcggcggagcatgcggattaattcgatgcaacgcgaagaaccttacctgggcttgacatgttcccgacggccgcggagacgcggcttcccttcggggcgggttcacaggtggtgcatggtcgtcgtcagctcgtgtcgtgagatgttgggttaagtcccgcaacgagcgcaaccctcgcctcgtgttgccagcgggtcatgccgggaactcacgagggaccgccggggttaacccggaggaaggtggggatgacgtcagatcatcatgccccttacgtccagggcttcacgcatgctacaatggccggtacagcgggatgcgacatggcgacatggagcggatccctgaaaaccggtctcagttcggatcggagcctgcaacccggctccgtgaaggcggagtcgctagtaatcgcggatcagcaacgccgcggtgaatgcgttcccgggccttgtacacaccgcccgtcaagtcatgaaagtgggtagcgcccgaagccggtggcccaaccagcctagctggggggagccgtctaaggtgggacccgtgattgggactaagtcgtaacaaggtagccgtaccggaaggtgcggctggatcacctcctttctacggag

SEQ ID NO: 1934 - DNA, 1552 bp, Bilophila sp. 4 1 30
  ref <308>: DATABASE ACCESSION NUMBER: NCBI ACCESSION: NZ_JH114232.1
  ref <309>: DATABASE ENTRY DATE: 2019-04-01
  ref <313>: RELEVANT RESIDUES IN SEQ ID NO: (1)..(1552)
caactggagagtttgattctggctcagattgaacgctggcggcgtgcttaacacatgcaagtcgaacgtgaaagtccttcgggatgagtaaagtggcgcacgggtgagtaacgcgtggataatctacccttaagatggggataacggctggaaacggtcgctaataccgaatacgctcccgattttatcgttggggggaaagatggcctctgcttgcaagctatcgcttaaggatgagtccgcgtcccattagctagttggcggggtaacggcccaccaaggcaacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcttggtaagtcaggggtgaaatcccacagcccaactgtggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgcccgtcacaccacgaaagtcggttttacccgaagccggtgagctaactcgcaagaggagcagccgtctacggtagggccgatgattggggtgaagtcgtaacaaggtagccgtaggggaacctgcggctggatcacctccttta

SEQ ID NO: 1935 - DNA, 1554 bp, Bilophila wadsworthia
  ref <308>: DATABASE ACCESSION NUMBER: NCBI ACCESSION: NZ_JNJP01000178.1
  ref <309>: DATABASE ENTRY DATE: 2019-04-01
  ref <313>: RELEVANT RESIDUES IN SEQ ID NO: (1)..(1554)
caactggagagtttgattctggctcagattgaacgctggcggcgtgcttaacacatgcaagtcgaacgtgaaagtccttcggggcgagtaaagtggcgcacgggtgagtaacgcgtggataatctacccttaagatggggataacggctggaaacggtcgctaataccgaatacgctcccgattttatcattggggggaaagatggcctctgcttgcaagctatcgcttaaggatgagtccgcgtcccattagctagttggcggggtaacggcccaccaaggcaacgatgggtagccggtctgagaggatgaccggccacactggaactggaacacggtccagactcctacgggaggcagcagtggggaatattgcgcaatgggcgaaagcctgacgcagcgacgccgcgtgagggatgaaggttctcggatcgtaaacctctgtcaggggggaagaaaccccctcgtgtgaataatgcgagggcttgacggtacccccaaaggaagcaccggctaactccgtgccagcagccgcggtaatacggagggtgcaagcgttaatcggaatcactgggcgtaaagcgcacgtaggcggcttggtaagtcaggggtgaaatcccacagcccaactgtggaactgcctttgatactgccaggcttgagtaccggagagggtggcggaattccaggtgtaggagtgaaatccgtagatatctggaggaacaccggtggcgaaggcggccacctggacggtaactgacgctgaggtgcgaaagcgtgggtagcaaacaggattagataccctggtagtccacgctgtaaacgatgggtgctgggtgctgggatgtatgtctcggtgccgtagctaacgcgataagcaccccgcctggggagtacggtcgcaaggctgaaactcaaagaaattgacgggggcccgcacaagcggtggagtatgtggtttaattcgatgcaacgcgaagaaccttacccaggcttgacatctagggaacccttcggaaatgaaggggtgcccttcggggagccctaagacaggtgctgcatggctgtcgtcagctcgtgccgtgaggtgttgggttaagtcccgcaacgagcgcaacccctatcttcagttgccagcaggtaaggctgggcactctggagagaccgccccggtcaacggggaggaaggtggggacgacgtcaagtcatcatggcccttacgcctggggctacacacgtactacaatggcgcgcacaaagggtagcgagaccgcgaggtggagccaatcccaaaaaacgcgtcccagtccggattggagtctgcaactcgactccatgaagtcggaatcgctagtaattcgagatcagcatgctcgggtgaatgcgttcccgggccttgtacacaccgcccgtcacaccacgaaagtcggttttacccgaagccggtgagctaactcgcaagaggagcagccgtctacggtagggccgatgattggggtgaagtcgtaacaaggtagccgtaggggaacctgcggctggatcacctcctttata

SEQ ID NO: 1936 - DNA, 1532 bp, Bittarella massiliensis
  ref <308>: DATABASE ACCESSION NUMBER: NCBI ACCESSION: NZ_LN908974.1
  ref <309>: DATABASE ENTRY DATE: 2019-04-01
  ref <313>: RELEVANT RESIDUES IN SEQ ID NO: (1)..(1532)
ttgataaagagtttgatcctggctcaggacgaacgctggcggcgcgcctaacacatgcaagtcgaacggacacatccgacggaatagcttgctaggaagatggatgttgttagtggcggacgggtgagtaacacgtgagcaacctgcctcggagtgggggacaacagttggaaacgactgctaataccgcatacggtggtcgggggacatcccctggctaagaaaggatctatgatccgctctgagatgggctcgcgtctgattagctagttggcggggtaacggcccaccaaggcaacgatcagtagccggactgagaggttgaacggccacattgggactgagacacggcccagactcctacgggaggcagcagtggggaatattgcacaatggggggaaccctgatgcagcgacgccgcgtgagggaagaaggttttcggattgtaaacctctgtcttgtgggacgataatgacggtaccacaggaggaagccatggctaactacgtgccagcagccgcggtaatacgtagatggcgagcgttgtccggaattactgggtgtaaagggagtgtaggcgggatcataagttgcgtgtgaaatgcaggggctcaacccctgaactgcgcgcaaaactgtggttcttgagtgaagtagaggcaggcggaattcccggtgtagcggtggaatgcgtagatatcgggaggaacaccagtggcgaaggcggcctgctgggcttttactgacgctgaggctcgaaagcatggggagcaaacaggattagataccctggtagtccatgccgtaaacgatgattactaggtgtggggggataaccccctccgtgccggagttaacacaataagtaatccacctggggagtacgaccgcaaggttgaaactcaaaggaattgacgggggcccgcacaagcagtggagtatgtggtttaattcgaagcaacgcgaaaaaccttaccaggtcttgacatctatcgctatcccaagagattgggagttcccttcggggacggtaagacaggtggtgcatggttgtcgtcagctcgtgtcgtgagatgttgggttaagtcccgcaacgagcgcaacccttactgttagttgctacgcaagagcactctaacgggactgccgttgacaaaacggaggaaggtggggatgacgtcaaatcatcatgccctttatgacctgggctacacacgtactacaatggccgcaaacaacgagcagcgaaaccgcgaggtggagcgaatctataaaagcggtctcagttcggattgcaggctgcaactcgcctgcatgaagtcggaattgctagtaatcgcggatcagcatgccgcggtgaatacgttcccgggccttgtacacaccgcccgtcacaccatgagagccggtaacacccgaagtcagtagtctaaccgcaagggggacgctgccgaaggtggggctggtgattggggtgaagtcgtaacaaggtagccgtatcggaaggtgcggctggatcacctcctttcta

SEQ ID NO: 1937 - DNA, 1492 bp, Blastochloris sp. GI
  ref <308>: DATABASE ACCESSION NUMBER: NCBI ACCESSION: NZ_AP018907.1
  ref <309>: DATABASE ENTRY DATE: 2019-04-01
  ref <313>: RELEVANT RESIDUES IN SEQ ID NO: (1)..(1492)
tcaacttgagagtttgatcctggctcagagcgaacgctggcggcaggcttaacacatgcaagtcgagcgccgtagcaatacggagcggcagacgggtgagtaacgcgtgggaacgtgccctaaggtacggaacaaccaagggaaactttggctaataccgtatgtgcccgagaggggaaagatttatcgccttaggagcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggggcaaccctgatccagccatgccgcgtgagtgatgaaggccttagggttgtaaagctctttcgacggggaagataatgacggtacccgtagaagaagccccggctaacttcgtgccagcagccgcggtaatacgaagggggctagcgttgctcggatttactgggcgtaaagcgcacgtaggcgggtcgttaagtcgggggtgaaatcccggagctcaactccggaactgccttcgatactggcgatctcgagtccgggagaggtgagtggaattccgagtgtagaggtgaaattcgtagatattcggaagaacaccagtggcgaaggcggctcactggcccggtactgacgctgaggtgcgaaagcgtggggagcaaacaggattagataccctggtagtccacgctgtaaacgatggaggctagccgttggtgagcatgctcatcagtggcgcagctaacgctttaagcctcccgcctggggagtacggtcgcaagattaaaactcaaaggaattgacgggggcccgcacaagcggtggagcatgtggtttaattcgaagcaacgcgcagaaccttaccagctcttgacatgccacgacgacttccagagatggatttcttcccgcaagggacgtgggcacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggcggtgacagtgggcagcgaaggggtgaccctaagctaatctccaaaagccgtctcagttcggattgcactctgcaactcgagtgcatgaagtcggaatcgctagtaatcgcagatcagcatgctgcggtgaatacgttcccgggccttgtacacaccgcccgtcacaccatgggagttggctttacccgaaggcgctgcgccaacccgcaaggggggcaggcgaccacggtagggtcagcgactggggtgaagtcgtaacaaggtagccgtaggggaacctgcggctggatcacctcctttctaa

SEQ ID NO: 1938 - DNA, 1494 bp, Blastochloris viridis
  ref <308>: DATABASE ACCESSION NUMBER: NCBI ACCESSION: NZ_AP014854.2
  ref <309>: DATABASE ENTRY DATE: 2019-04-01
  ref <313>: RELEVANT RESIDUES IN SEQ ID NO: (1)..(1494)
caacttgagagtttgatcctggctcagagcgaacgctggcggcaggcttaacacatgcaagtcgagcgccgtagcaatacggagcggcagacgggtgagtaacgcgtgggaatgtgcccaaaggtacggaacaaccaagggaaactttggctaataccgtatgtgcccgagaggggaaagatttattgcctttggagcagcccgcgtctgattagctagttggtggggtaacggcccaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgacggggaagataatgacggtacccgtagaagaagccccggctaacttcgtgccagcagccgcggtaatacgaagggggctagcgttgctcggatttactgggcgtaaagcgcacgtaggcgggtcgttaagtcgggggtgaaatcccggagctcaactccggaactgccttcgatactggcgacctcgagtccgggagaggtgagtggaactccgagtgtagaggtgaaattcgtagatattcggaagaacaccagtggcgaaggcggctcactggcccggtactgacgctgaggtgcgaaagcgtggggagcaaacaggattagataccctggtagtccacgccgtaaacgatggaggctagccgttggtgagcatgctcatcagtggcgcagctaacgctttaagcctcccgcctggggagtacggtcgcaagattaaaactcaaaggaattgacgggggcccgcacaagcggtggagcatgtggtttaattcgaagcaacgcgcagaaccttaccagctcttgacatgccacgacggttcccagagatgggttctttcccgcaagggacgtggacacaggtgctgcatggctgtcgtcagctcgtgtcgtgagatgttgggttaagtcccgcaacgagcgcaaccctcgcccttagttgccatcatttagttgggcactctaaggggactgccggtgataagccgagaggaaggtggggatgacgtcaagtcctcatggcccttacgggctgggctacacacgtgctacaatggcggtgacagtgggcagcgaaggggcgaccctgagctaatctccaaaagccgtctcagttcggattgcactctgcaactcgagtgcatgaagtcggaatcgctagtaatcgcagatcagcatgctgcggtgaatacgttcccgggccttgtacacaccgcccgtcacaccatgggagttggctttacccgaaggcgctgcgccaacccgcgaggggggcaggcgaccacggtagggtcagcgactggggtgaagtcgtaacaaggtagccgtaggggaacctgcggctggatcacctcctttctaagga

SEQ ID NO: 1939 - DNA, 1527 bp, Blastococcus litoris
  ref <308>: DATABASE ACCESSION NUMBER: NCBI ACCESSION: NZ_QCZF01000021.1
  ref <309>: DATABASE ENTRY DATE: 2019-04-01
  ref <313>: RELEVANT RESIDUES IN SEQ ID NO: (1)..(1527)
tctacggagagtttgatcctggctcaggacgaacgctggcggcgtgcttaacacatgcaagtcgaacggtgaactcgcttcggtgggggatcagtggcgaacgggtgagtaacacgtgggcaacctgcccctggctctgggataactccaagaaattggggctaataccggatatgaccgctgaccgcatggtctggtggtggaaagatttatcggctggggatgggcccgcggcctatcagcttgttggtggggtagtggcctaccaaggcgacgacgggtagccggcctgagagggtgaccggccacactgggactgagacacggcccagactcctacgggaggcagcagtggggaatattgcgcaatgggcgaaagcctgacgcagcgacgccgcgtgggggatgacggccttcgggttgtaaacctctttcagcagggacgaagcgagagtgacggtacctgcagaagaagcaccggccaactacgtgccagcagccgcggtaatacgtagggtgcaagcgttgtccggaattattgggcgtaaagagctcgtaggcggtttgttgcgtcggctgtgaaatcccgaggctcaacctcgggtctgcagtcgatacgagcaaactagagtgttgcaggggagactggaattcctggtgtagcggtgaaatgcgcagatatcaggaggaacaccggtggcgaaggcgggtctctgggcaacaactgacgctgaggagcgaaagcgtggggagcgaacaggattagataccctggtagtccacgccgtaaacgttgggcgctaggtgtggggctcattccacgagttccgtgccgcagctaacgcattaagcgccccgcctggggagtacggccgcaaggctaaaactcaaaggaattgacgggggcccgcacaagcggcggagcatgttgcttaattcgatgcaacgcgaagaaccttacctaggcttgacatgcacggaaatctcccagagatggggggtccgtaagggccgtgcacaggtggtgcatggttgtcgtcagctcgtgtcgtgagatgttgggttaagtcccgcaacgagcgcaaccctcgtcctatgttgccagcacgtgatggtggggactcataggagactgccggggtcaactcggaggaaggtggggatgacgtcaaatcatcatgccccttatgtctagggctgcaaacatgctacaatggccggtacaaagggctgcgataccgtgaggtggagcgaatcccaaaaagccggtctcagttcggattggggtctgcaactcgaccccatgaagttggagtcgctagtaatcgcagatcagcaacgctgcggtgaatacgttcccgggccttgtacacaccgcccgtcacgtcacgaaagtcggtaacgcccgaagccggtggcccaacccttgtggagggagccgtcgaaggcgggatcggcgattgggacgaagtcgtaacaaggtagccgtaccggaaggtgcggctggatcacctcctttctaaggag

SEQ ID NO: 1940 - DNA, 1493 bp, Blastomonas fulva
  ref <308>: DATABASE ACCESSION NUMBER: NCBI ACCESSION: NZ_CP020083.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcatgcctaacacatgcaagtcgaacgagaccttcgggtctagtggcgcacgggtgcgtaacgcgtgggaatctgcctttgggttcggaataacagtgagaaattactgctaataccggatgatgtcttcggaccaaagatttatcgcccaaagatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggctagtatattttccagagatggattatttcagttcggctggctagcacacaggtgctgcatggctgtcgtcagctcgtgtcgtgagatgttgggttaagtcccgcaacgagcgcaaccctcgtctttagttgccatcattaagttgggcactctaaagaaaccgccggtgataagccggaggaaggtggggatgacgtcaagtcctcatggcccttacacgctgggctacacacgtgctacaatggcggtgacagtgggcagcaagcacgcgagtgcaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacctcctttctaag

SEQ ID NO: 1941 - DNA, 1493 bp, Blastomonas natatoria
  ref <308>: DATABASE ACCESSION NUMBER: NCBI ACCESSION: NZ_QJJM01000036.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcatgcctaacacatgcaagtcgaacgaaggcttcggccttagtggcgcacgggtgcgtaacgcgtgggaatctgcccttgggttcggaataacagtgagaaattactgctaataccggatgatgacttcggtccaaagatttatcgcccaaggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggccattcaagtcagaggtgaaagcccggggctcaaccccggaactgcctttgaaactagatggcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtctagtatgtttcccagagatgggttacttcagttcggctggctagaacacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacacgctgggctacacacgtgctacaatggcggtgacagtgagcagctagatcgcgagatcatgctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacctcctttctaag

SEQ ID NO: 1942 - DNA, 1495 bp, Blastomonas sp. AAP25
  ref <308>: DATABASE ACCESSION NUMBER: NCBI ACCESSION: NZ_LJHP01000048.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgagaccttcgggtctagtggcgcacgggtgcgtaacgcgtgggaatctgcctttgggttcggaataacagtgagaaattactgctaataccggatgatgtcttcggaccaaagatttatcgcccaaagatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggctagtatattttccagagatggattatttcagttcggctggctagcacacaggtgctgcatggctgtcgtcagctcgtgtcgtgagatgttgggttaagtcccgcaacgagcgcaaccctcgtctttagttgccatcattaagttgggcactctaaagaaaccgccggtgataagccggaggaaggtggggatgacgtcaagtcctcatggcccttacacgctgggctacacacgtgctacaatggcggtgacagtgggcagcaagcacgcgagtgcaagctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacctcctttctaagga

SEQ ID NO: 1943 - DNA, 1495 bp, Blastomonas sp. AAP53
  ref <308>: DATABASE ACCESSION NUMBER: NCBI ACCESSION: NZ_ANFZ01000002.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgaagtcttcggacttagtggcgcacgggtgcgtaacgcgtgggaatctgcccttgggttcggaataacagtgagaaattactgctaataccggatgatgtcttcggaccaaagatttatcgcccaaggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggctagtatattttccagagatggattatttcagttcggctggctagcacacaggtgctgcatggctgtcgtcagctcgtgtcgtgagatgttgggttaagtcccgcaacgagcgcaaccctcgtctttagttgccatcattaagttgggcactctaaagaaaccgccggtgataagccggaggaaggtggggatgacgtcaagtcctcatggcccttacacgctgggctacacacgtgctacaatggcggtgacagtgggcagcaagcgcgcgagcgcaagctaatctctaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacctcctttctaagga

SEQ ID NO: 1944 - DNA, 1495 bp, Blastomonas sp. CCH1-A6
  ref <308>: DATABASE ACCESSION NUMBER: NCBI ACCESSION: NZ_LSIS01000281.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgaaggcttcggccttagtggcgcacgggtgcgtaacgcgtgggaatctgcccttgggttcggaataacagtgagaaattactgctaataccggatgatgacttcggtccaaagatttatcgcccaaggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggccattcaagtcagaggtgaaagcccggggctcaaccccggaactgcctttgaaactagatggcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatgtctagtatgtttcccagagatgggttacttcagttcggctggctagaacacaggtgctgcatggctgtcgtcagctcgtgtcgtgagatgttgggttaagtcccgcaacgagcgcaaccctcgtctttagttgccatcatttagttgggcactctaaagaaaccgccggtgataagccggaggaaggtggggatgacgtcaagtcctcatggcccttacacgctgggctacacacgtgctacaatggcggtgacagtgagcagctagatcgcgagatcatgctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacctcctttctaagga

SEQ ID NO: 1945 - DNA, 1495 bp, Blastomonas sp. CCH11-A4
  ref <308>: DATABASE ACCESSION NUMBER: NCBI ACCESSION: NZ_LSKB01000077.1
  ref <309>: DATABASE ENTRY DATE: 2019-04-01
  ref <313>: RELEVANT RESIDUES IN SEQ ID NO: (1)..(1495)
aacttgagagtttgatcctggctcagaacgaacgctggcggcatgcctaacacatgcaagtcgaacgaaggcttcggccttagtggcgcacgggtgcgtaacgcgtgggaatctgcccttgggttcggaataacagtgagaaattactgctaataccggatgatgacttcggtccaaagatttatcgcccaaggatgagcccgcgtaagattagctagttggtgaggtaaaggctcaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggccattcaagtcagaggtgaaagcccggggctcaaccccggaactgcctttgaaactagatggcttgaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatggctagtatgatttccagagatggatttcttcagttcggctggctagcacacaggtgctgcatggctgtcgtcagctcgtgtcgtgagatgttgggttaagtcccgcaacgagcgcaaccctcgtctttagttgccatcattcagttgggcactctaaagaaaccgccggtgataagccggaggaaggtggggatgacgtcaagtcctcatggcccttacacgctgggctacacacgtgctacaatggcggtgacagtgagcagctagatcgcgagatcatgctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggttcagcgactggggtgaagtcgtaacaaggtagccgtaggggaacctgcggctggatcacctcctttctaagga

SEQ ID NO: 1946 - DNA, 1495 bp, Blastomonas sp. CCH15-G10; identical to SEQ ID NO: 1945
  ref <308>: DATABASE ACCESSION NUMBER: NCBI ACCESSION: NZ_LSHV01000091.1
  ref <309>: DATABASE ENTRY DATE: 2019-04-01
  ref <313>: RELEVANT RESIDUES IN SEQ ID NO: (1)..(1495)

SEQ ID NO: 1947 - DNA, 1495 bp, Blastomonas sp. CCH3-A3; identical to SEQ ID NO: 1945
  ref <308>: DATABASE ACCESSION NUMBER: NCBI ACCESSION: NZ_LSHH01000015.1
  ref <309>: DATABASE ENTRY DATE: 2019-04-01
  ref <313>: RELEVANT RESIDUES IN SEQ ID NO: (1)..(1495)

SEQ ID NO: 1948 - DNA, 1495 bp, Blastomonas sp. CCH3-E3; identical to SEQ ID NO: 1945
  ref <308>: DATABASE ACCESSION NUMBER: NCBI ACCESSION: NZ_LSHR01000025.1
  ref <309>: DATABASE ENTRY DATE: 2019-04-01
  ref <313>: RELEVANT RESIDUES IN SEQ ID NO: (1)..(1495)

SEQ ID NO: 1949 - DNA, 1495 bp, Blastomonas sp. CCH4-D12; identical to SEQ ID NO: 1945
  ref <308>: DATABASE ACCESSION NUMBER: NCBI ACCESSION: NZ_LSHZ01000064.1
  ref <309>: DATABASE ENTRY DATE: 2019-04-01
  ref <313>: RELEVANT RESIDUES IN SEQ ID NO: (1)..(1495)

SEQ ID NO: 1950 - DNA, 1495 bp, Blastomonas sp. CCH5-A3; identical to SEQ ID NO: 1945
  ref <308>: DATABASE ACCESSION NUMBER: NCBI ACCESSION: NZ_LSIO01000198.1
  ref <309>: DATABASE ENTRY DATE: 2019-04-01
  ref <313>: RELEVANT RESIDUES IN SEQ ID NO: (1)..(1495)

SEQ ID NO: 1951 - DNA, 1495 bp, Blastomonas sp. CCH5-E3; identical to SEQ ID NO: 1945
  ref <308>: DATABASE ACCESSION NUMBER: NCBI ACCESSION: NZ_LSHY01000037.1
  ref <309>: DATABASE ENTRY DATE: 2019-04-01
  ref <313>: RELEVANT RESIDUES IN SEQ ID NO: (1)..(1495)

SEQ ID NO: 1952 - DNA, 1495 bp, Blastomonas sp. CCH6-A6; identical to SEQ ID NO: 1945
  ref <308>: DATABASE ACCESSION NUMBER: NCBI ACCESSION: NZ_LSHJ01000079.1
  ref <309>: DATABASE ENTRY DATE: 2019-04-01
  ref <313>: RELEVANT RESIDUES IN SEQ ID NO: (1)..(1495)

SEQ ID NO: 1953 - DNA, 1495 bp, Blastomonas sp. CCH8-A3; identical to SEQ ID NO: 1945
  ref <308>: DATABASE ACCESSION NUMBER: NCBI ACCESSION: NZ_LSHS01000062.1
  ref <309>: DATABASE ENTRY DATE: 2019-04-01
  ref <313>: RELEVANT RESIDUES IN SEQ ID NO: (1)..(1495)

SEQ ID NO: 1954 - DNA, 1495 bp, Blastomonas sp. CCH9-A1; identical to SEQ ID NO: 1945
  ref <308>: DATABASE ACCESSION NUMBER: NCBI ACCESSION: NZ_LSHM01000028.1
  ref <309>: DATABASE ENTRY DATE: 2019-04-01
  ref <313>: RELEVANT RESIDUES IN SEQ ID NO: (1)..(1495)

SEQ ID NO: 1955 - DNA, 1495 bp, Blastomonas sp. CCH9-F3; identical to SEQ ID NO: 1945
  ref <308>: DATABASE ACCESSION NUMBER: NCBI ACCESSION: NZ_LSHI01000023.1
  ref <309>: DATABASE ENTRY DATE: 2019-04-01
  ref <313>: RELEVANT RESIDUES IN SEQ ID NO: (1)..(1495)

SEQ ID NO: 1956 - DNA, 1495 bp, Blastomonas sp. RAC04; identical to SEQ ID NO: 1942
  ref <308>: DATABASE ACCESSION NUMBER: NCBI ACCESSION: NZ_CP016460.1
  ref <309>: DATABASE ENTRY DATE: 2019-04-01
  ref <313>: RELEVANT RESIDUES IN SEQ ID NO: (1)..(1495)

SEQ ID NO: 1957 - DNA, 1188 bp, Blastomonas sp. UPD001
  ref <308>: DATABASE ACCESSION NUMBER: NCBI ACCESSION: NZ_QKVT01000001.1
  ref <309>: DATABASE ENTRY DATE: 2019-04-01
  ref <313>: RELEVANT RESIDUES IN SEQ ID NO: (1)..(1188)
gactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacggagacgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggcagtgcgctaaccgcaaggaggcagccgaccacggtagggtcagcgactggggtgaagtcgtaacaaggtagccgtaggggaacctgcggctggatcacctcctttctaag

SEQ ID NO: 1958 - DNA, 1541 bp, Blautia coccoides
  ref <308>: DATABASE ACCESSION NUMBER: NCBI ACCESSION: NZ_UFVT01000001.1
  ref <309>: DATABASE ENTRY DATE: 2019-04-01
  ref <313>: RELEVANT RESIDUES IN SEQ ID NO: (1)..(1541)
tttatcagagagtttgatcctggctcaggatgaacgctggcggcgtgcttaacacatgcaagtcgagcgaagcactaagacagatttcttcggattgaagtctttgtgactgagcggcggacgggtgagtaacgcgtgggtaacctgcctcatacagggggataacagttagaaatgactgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaacgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtagccgtatcggaaggtgcggctggatcacctcctttctaaggaa

SEQ ID NO: 1959 - DNA, 1541 bp, Blautia hominis
  ref <308>: DATABASE ACCESSION NUMBER: NCBI ACCESSION: NZ_NQOF01000001.1
  ref <309>: DATABASE ENTRY DATE: 2019-04-01
  ref <313>: RELEVANT RESIDUES IN SEQ ID NO: (1)..(1541)
tttatcagagagtttgatcctggctcaggatgaacgctggcggcgtgcttaacacatgcaagtcgagcgaagcattaagacggatctcttcggattgaagtcttattgactgagcggcggacgggtgagtaacgcgtgggtaacctgcctcatacagggggataacagttagaaatgactgctaataccgcataagcgcacagggctgcatggcctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacgtgcccgtaacggggcattcccttcggggcagaggagacaggtggtgcatggttgtcgtcagctcgtgtcgtgagatgttgggttaagtcccgcaacgagcgcaacccctatccttagtagccagcaggtcaagctgggcactctagggagactgccggggataacccggaggaaggcggggacgacgtcaaatcatcatgccccttatgatttgggctacacacgtgctacaatggcgtaaacaaagggaagcgagacagcgatgtttagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttctaaggaa

SEQ ID NO: 1960 - DNA, 1542 bp, Blautia marasmi
  ref <308>: DATABASE ACCESSION NUMBER: NCBI ACCESSION: NZ_OIWX01000001.1
  ref <309>: DATABASE ENTRY DATE: 2019-04-01
  ref <313>: RELEVANT RESIDUES IN SEQ ID NO: (1)..(1542)
tttatcagagagtttgatcctggctcaggatgaacgctggcggcgtgcttaacacatgcaagtcgagcgaagcatttaagacgatttcttcggattgagtcttatatgactgagcggcggacgggtgagtaacgcgtgggtaacctgcctcatacagggggataacagttagaaatgactgctaataccgcataagcgcacagggctgcatggcctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacgtgcccgtaacggggcattcccttcggggcagaggagacaggtggtgcatggttgtcgtcagctcgtgtcgtgagatgttgggttaagtcccgcaacgagcgcaacccctatctttagtagccagcaggtcaagctgggcactctagggagactgccggggataacccggaggaaggcggggacgacgtcaaatcatcatgccccttatgatttgggctacacacgtgctacaatggcgtaaacaaagggaagcgagacagcgatgtttagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttaatggagggagctgccgaaggcgggaccgataactggggtgaagtcgtaacaaggtagccgtatcggaaggtgcggctggatcacctcctttctaaggaa

SEQ ID NO: 1961 - DNA, 1728 bp, Blautia massiliensis
  misc_feature (391)..(391): n is a, c, g, or t
  ref <308>: DATABASE ACCESSION NUMBER: NCBI ACCESSION: NZ_LN913006.1
  ref <309>: DATABASE ENTRY DATE: 2019-04-01
  ref <313>: RELEVANT RESIDUES IN SEQ ID NO: (1)..(1728)
tttatcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatgactgctaataccgcataagcgcacaggaccgcatggtccggtgtgaaaaactccggtggtataagatggacccgcgttggattagctagttggtgaggtaacggcccaccaaggcgacgatccatagccggcctgagagggtgaacggccacattgggactgagacacggcccagactcctacgggaggcagcagtggggaatattgcacaatgnagctgcatggctcagtgtgaaaaactccggtggtataagatggacccgcgttggattagctagttggtgaggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgtcggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccctctgaccggaacttaaccgttcctttccttcgggacagaggagacaggtggtgcatggttgtcgtcagctcgtgtcgtgagatgttgggttaagtcccgcaacgagcgcaacccctatccccagtagccagcggttcggccgggcactctgaggagactgccagggataacctggaggaaggcggggatgacgtcaaatcatcatgccccttatgatttgggctacacacgtgctacaatggcgtaaacaaagggaagcgaacctgcgagggtgggcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgcaaggaaggagctgccgaaggcgggaccgatgactggggtgaagtcgtaacaaggtagccgtatcggaaggtgcggctggatcacctcctttctaaggaa

SEQ ID NO: 1962 - DNA, 1432 bp, Blautia obeum
  ref <308>: DATABASE ACCESSION NUMBER: NCBI ACCESSION: NZ_RCXQ01000046.1
  ref <309>: DATABASE ENTRY DATE: 2019-04-01
  ref <313>: RELEVANT RESIDUES IN SEQ ID NO: (1)..(1432)
gtttctagtggcggacgggtgagtaacgcgtgggtaacctgccttatacagggggataacaaccagaaatggttgctaataccgcataagcgcacaggaccgcatggtccggtgtgaaaaactccggtggtataagatggacccgcgttggattagctagttggcagggtaacggcctaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacaggggagacaggtggtgcatggttgtcgtcagctcgtgtcgtgagatgttgggttaagtcccgcaacgagcgcaacccctatccccagtagccagcagtccggctgggcactctgaggagactgccagggataacctggaggaaggcggggatgacgtcaaatcatcatgccccttatgatttgggctacacacgtgctacaatggcgtaaacaaagggaagcaagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaagg

SEQ ID NO: 1963 - DNA, 1542 bp, Blautia producta
  ref <308>: DATABASE ACCESSION NUMBER: NCBI ACCESSION: NZ_PQGB01000638.1
  ref <309>: DATABASE ENTRY DATE: 2019-04-01
  ref <313>: RELEVANT RESIDUES IN SEQ ID NO: (1)..(1542)
tttatcagagagtttgatcctggctcaggatgaacgctggcggcgtgcttaacacatgcaagtcgagcgaagcacttgaacggatttcttcggattgaagtttttgtgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggttgtcgtcagctcgtgtcgtgagatgttgggttaagtcccgcaacgagcgcaacccctatccttagtagccagcaggtgaagctgggcactctagggagactgccggggataacccggaggaaggcggggacgacgtcaaatcatcatgccccttatgatttgggctacacacgtgctacaatggcgtaaacaaagggaagcgagacagcgatgttgagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttataggagggagctgccgaaggcgggaccgataactggggtgaagtcgtaacaaggtagccgtatcggaaggtgcggctggatcacctcctttctaaggaa

SEQ ID NO: 1964 - DNA, 302 bp, Blautia schinkii
  ref <308>: DATABASE ACCESSION NUMBER: NCBI ACCESSION: NZ_JNKJ01000052.1
  ref <309>: DATABASE ENTRY DATE: 2019-04-01
  ref <313>: RELEVANT RESIDUES IN SEQ ID NO: (1)..(302)
tttatcagagagtttgatcctggctcaggatgaacgctggcggcgtgcttaacacatgcaagtcgaacggagattgatttaacagagacttcggttgaagttgttttaatcttagtggcggacgggtgagtaacgcgtgggtaacctgccttgtactgggggataacagccagaaatgactgctaataccgcataagcgcacaggaccgcatggtctggtgtgaaaaactccggtggtacaagatggacccgcgttggattagctagttggcagggcaaaggcctaccaaggcgacgatcca

SEQ ID NO: 1965 - DNA, 1542 bp, Blautia sp. AF13-16
  ref <308>: DATABASE ACCESSION NUMBER: NCBI ACCESSION: NZ_QUHN01000018.1
  ref <309>: DATABASE ENTRY DATE: 2019-04-01
  ref <313>: RELEVANT RESIDUES IN SEQ ID NO: (1)..(1542)
tttatcagagagtttgatcctggctcaggatgaacgctggcggcgtgcttaacacatgcaagtcgagcgaagcacttgaacggatttcttcggattgaagtttttgtgactgagcggcggacgggtgagtaacgcgtgggtaacctgcctcatacagggggataacagttagaaatggctgctaataccgcataagcgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggttgtcgtcagctcgtgtcgtgagatgttgggttaagtcccgcaacgagcgcaacccctatccttagtagccagcaggtgaagctgggcactctagggagactgccggggataacccggaggaaggcggggacgacgtcaaatcatcatgccccttatgatttgggctacacacgtgctacaatggcgtaaacaaagggaagcgagacagtgatgttgagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcagtaacgcccgaagtcagtgacccaaccttataggagggagctgccgaaggcgggaccgataactggggtgaagtcgtaacaaggtagccgtatcggaaggtgcggctggatcacctcctttctaaggaa

SEQ ID NO: 1966 - DNA, 1539 bp, Blautia sp. AF19-10LB
  ref <308>: DATABASE ACCESSION NUMBER: NCBI ACCESSION: NZ_QTWS01000007.1
  ref <309>: DATABASE ENTRY DATE: 2019-04-01
  ref <313>: RELEVANT RESIDUES IN SEQ ID NO: (1)..(1539)
tttatcagagagtttgatcctggctcaggatgaacgctggcggcgtgcttaacacatgcaagtcgaacgggaaacctattattgaaacttcggtcgatttaatttgtttctagtggcggacgggtgagtaacgcgtgggtaacctgccctatacagggggataacaaccagaaatggttgctaataccgcataagcgcacgggaccgcatggtccagtgtgaaaaactccggtggtataggatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgatccgtaacgggatctttccttcgggacaggggagacaggtggtgcatggttgtcgtcagctcgtgtcgtgagatgttgggttaagtcccgcaacgagcgcaacccctatccccagtagccagcggtttggccgggcactctgaggagactgccagggataacctggaggaaggcggggatgacgtcaaatcatcatgccccttatgatttgggctacacacgtgctacaatggcgtaaacaaagggaagcgagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 1967 - DNA, 1543 bp, Blautia sp. AF19-13LB
  ref <308>: DATABASE ACCESSION NUMBER: NCBI ACCESSION: NZ_QUGO01000004.1
  ref <309>: DATABASE ENTRY DATE: 2019-04-01
  ref <313>: RELEVANT RESIDUES IN SEQ ID NO: (1)..(1543)
tttatcagagagtttgatcctggctcaggatgaacgctggcggcgtgcttaacacatgcaagtcgagcgaagcagttaagttgatttcttcggattgattcttaactgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccgtttacggagggagctgccgaaggcgggactgataactggggtgaagtcgtaacaaggtagccgtatcggaaggtgcggctggatcacctcctttctaaggaa

SEQ ID NO: 1968 - DNA, 1458 bp, Blautia sp. AF19-34
  ref <308>: DATABASE ACCESSION NUMBER: NCBI ACCESSION: NZ_QUGJ01000004.1
  ref <309>: DATABASE ENTRY DATE: 2019-04-01
  ref <313>: RELEVANT RESIDUES IN SEQ ID NO: (1)..(1458)
gattcttcggatgaagtccttagtgactgagtggcggacgggtgagtaacgcgtgggtaacctgcctcatacagggggataacagttagaaatggctgctaataccgcataagcgcacggtactgcatggtacagtgtgaaaaactccggtggtatgagatggacccgcgttggattagctagttggcagggtaacggcctaccaaggcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgtcaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggactgtaatgagtcctttcccttcggggacagagaagacaggtggtgcatggttgtcgtcagctcgtgtcgtgagatgttgggttaagtcccgcaacgagcgcaacccttatcctcagtagccagcaagtgaagttgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaagggaggagccgtcgaaggtgggaccgataactggggtgaagtcgtaacaaggtagccgtatcggaaggtgcggctggatcacctcctttctaagg

SEQ ID NO: 1969 - DNA, 1544 bp, Blautia sp. AF22-5LB
  ref <308>: DATABASE ACCESSION NUMBER: NCBI ACCESSION: NZ_QUFX01000034.1
  ref <309>: DATABASE ENTRY DATE: 2019-04-01
  ref <313>: RELEVANT RESIDUES IN SEQ ID NO: (1)..(1544)
tttatttagagagtttgatcctggctcaggatgaacgctggcggcgtgcttaacacatgcaagtcgaacgaagcacttcggacagattcttcggatgaagtccttagtgactgagtggcggacgggtgagtaacgcgtgggtaacctgcctcatacagggggataacagttagaaatggctgctaataccgcataagcgcacggtactgcatggtacagtgtgaaaaactccggtggtatgagatggacccgcgttggattagctagttggcagggtaacggcctaccaaggcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgtcaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgatctgaccggactgtaatgagtcctttcccttcggggacagagaagacaggtggtgcatggttgtcgtcagctcgtgtcgtgagatgttgggttaagtcccgcaacgagcgcaacccttatcctcagtagccagcaagtgaagttgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaagggaggagccgtcgaaggtgggaccgataactggggtgaagtcgtaacaaggtagccgtatcggaaggtgcggctggatcacctcctttctaaggaa

SEQ ID NO: 1970 - DNA, 1436 bp, Blautia sp. AF26-2
  ref <308>: DATABASE ACCESSION NUMBER: NCBI ACCESSION: NZ_QTWD01000025.1
  ref <309>: DATABASE ENTRY DATE: 2019-04-01
  ref <313>: RELEVANT RESIDUES IN SEQ ID NO: (1)..(1436)
tgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccttttaggagggagctgccgaaggcgggactgataactggggtgaagtcgtaacaaggtagccgtatcggaaggtgcggctggatcacctcctttctaaggaa

SEQ ID NO: 1971 - DNA, 1522 bp, Blautia sp. AF32-4BH
  ref <308>: DATABASE ACCESSION NUMBER: NCBI ACCESSION: NZ_QTVL01000008.1
  ref <309>: DATABASE ENTRY DATE: 2019-04-01
  ref <313>: RELEVANT RESIDUES IN SEQ ID NO: (1)..(1522)
tggctcaggatgaacgctggcggcgtgcttaacacatgcaagtcgagcgaagcagttaagttgatttcttcggattgattcttaactgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaacctttcaggagggagctgccgaaggcgggactgataactggggtgaagtcgtaacaaggtagccgtatcggaaggtgcggctggatcacctcctttctaaggaa

SEQ ID NO: 1972 - DNA, 1336 bp, Blautia sp. AF34-10
  ref <308>: DATABASE ACCESSION NUMBER: NCBI ACCESSION: NZ_QUED01000077.1
  ref <309>: DATABASE ENTRY DATE: 2019-04-01
  ref <313>: RELEVANT RESIDUES IN SEQ ID NO: (1)..(1336)
actgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaacc

SEQ ID NO: 1973 - DNA, 1575 bp, Blautia sp. AM16-16B
  ref <308>: DATABASE ACCESSION NUMBER: NCBI ACCESSION: NZ_QTUS01000045.1
  ref <309>: DATABASE ENTRY DATE: 2019-04-01
  ref <313>: RELEVANT RESIDUES IN SEQ ID NO: (1)..(1575)
atggagagtttgatcctggctcaggacgaacgctggcggcgtgcttaacacatgcaagtcgaacgagaggacaagagaagcttgcttcttttggaatcgagtggcaaacgggtgagtaacacgtaaacaacctgccttcaggatggggacaacagacggaaacgactgctaataccgaatacgcttggaagaccgcatgattttccaaggaaagggtggcctctacctgtaagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgaccggggacgaacggtctgtaagctaataccttatggaagtgacggtacccggatagcaagccacggctaactacgtgccagcagccgcggtaatacgtaggtggcaagcgttgtccggaattattgggcgtaaagcgcgcgcaggcggcttcctaagtccatcttaaaagtgcggggcttaaccccgtgatgggatggaaactgggaagctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgatcgctatccgcagaaatgtggagttctccttcgggagacgagaaaacaggtggtgcacggctgtcgtcagctcgtgtcgtgagatgttgggttaagtcccgcaacgagcgcaacccctatcttatgttaccagcacgttatggtggggactcatgagagaccgccgcggacaacgcggaggaaggtggggatgacgtcaagtcatcatgccccttatgacctgggctacacacgtactacaatgggtgtcaacaaagagaagcgaaaccgcgaggtggagcgaacctcaaaaacacacccccagttcagattgcaggctgcaacccgcctgcatgaagtaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggagccgatgattggagtgaagtcgtaacaaggtagccgtatcggaaggtgcggctggatcacctcctttctaaggaga

SEQ ID NO: 1974 - DNA, 1544 bp, Blautia sp. AM22-22LB
  ref <308>: DATABASE ACCESSION NUMBER: NCBI ACCESSION: NZ_QUCK01000052.1
  ref <309>: DATABASE ENTRY DATE: 2019-04-01
  ref <313>: RELEVANT RESIDUES IN SEQ ID NO: (1)..(1544)
tttatttagagagtttgatcctggctcaggatgaacgctggcggcgtgcttaacacatgcaagtcgaacgaagcactttggacggattcttcggatgaagtccttagtgactgagtggcggacgggtgagtaacgcgtgggtaacctgcctcatacagggggataacagttagaaatggctgctaataccgcataagcacacggtactgcatggtacagtgtgaaaaactccggtggtatgagatggacccgcgttggattagctagttggcagggtaacggcctaccaaggcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgtcaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgatctgaccggactgtaatgagtcctttcccttcggggacagagaagacaggtggtgcatggttgtcgtcagctcgtgtcgtgagatgttgggttaagtcccgcaacgagcgcaacccttatcctcagtagccagcaagtgaagttgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaagggaggagccgtcgaaggtgggaccgataactggggtgaagtcgtaacaaggtagccgtatcggaaggtgcggctggatcacctcctttctaaggaa

SEQ ID NO: 1975 - DNA, 1436 bp, Blautia sp. AM23-13AC
  ref <308>: DATABASE ACCESSION NUMBER: NCBI ACCESSION: NZ_QTUL01000037.1
  ref <309>: DATABASE ENTRY DATE: 2019-04-01
  ref <313>: RELEVANT RESIDUES IN SEQ ID NO: (1)..(1436)
tgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaacctttcaggagggagctgccgaaggcgggactgataactggggtgaagtcgtaacaaggtagccgtatcggaaggtgcggctggatcacctcctttctaaggaa

SEQ ID NO: 1976 - DNA, 1542 bp, Blautia sp. AM28-10
  ref <308>: DATABASE ACCESSION NUMBER: NCBI ACCESSION: NZ_QUJP01000001.1
  ref <309>: DATABASE ENTRY DATE: 2019-04-01
  ref <313>: RELEVANT RESIDUES IN SEQ ID NO: (1)..(1542)
tttatcagagagtttgatcctggctcaggatgaacgctggcggcgtgcttaacacatgcaagtcgagcgaagcagttaagttgatttcttcggattgattcttaactgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccttttaggagggagctgccgaaggcgggactgataactggggtgaagtcgtaacaaggtagccgtatcggaaggtgcggctggatcacctcctttctaaggaa

SEQ ID NO: 1977 - DNA, 1542 bp, Blautia sp. AM28-27; identical to SEQ ID NO: 1976
  ref <308>: DATABASE ACCESSION NUMBER: NCBI ACCESSION: NZ_QUJK01000001.1
  ref <309>: DATABASE ENTRY DATE: 2019-04-01
  ref <313>: RELEVANT RESIDUES IN SEQ ID NO: (1)..(1542)

SEQ ID NO: 1978 - DNA, 1540 bp, Blautia sp. AM28-36
  ref <308>: DATABASE ACCESSION NUMBER: NCBI ACCESSION: NZ_QTYM01000008.1
  ref <309>: DATABASE ENTRY DATE: 2019-04-01
  ref <313>: RELEVANT RESIDUES IN SEQ ID NO: (1)..(1540)
tttatcagagagtttgatcctggctcaggatgaacgctggcggcgtgcttaacacatgcaagtcgagcgaagcggctgaattgattcttcggatgattttcggttgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccttttaggagggagctgccgaaggcgggactgataactggggtgaagtcgtaacaaggtagccgtatcggaaggtgcggctggatcacctcctttctaaggaa

SEQ ID NO: 1979 - DNA, 1158 bp, Blautia sp. AM46-3MH
  ref <308>: DATABASE ACCESSION NUMBER: NCBI ACCESSION: NZ_QUIA01000088.1
  ref <309>: DATABASE ENTRY DATE: 2019-04-01
  ref <313>: RELEVANT RESIDUES IN SEQ ID NO: (1)..(1158)
gcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgtcaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgatctgaccggactgtaatgagtcctttcccttcggggacagagaagacaggtggtgcatggttgtcgtcagctcgtgtcgtgagatgttgggttaagtcccgcaacgagcgcaacccttatcctcagtagccagcaagtgaagttgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaagg

SEQ ID NO: 1980 - DNA, 1233 bp, Blautia sp. AM46-5
  ref <308>: DATABASE ACCESSION NUMBER: NCBI ACCESSION: NZ_QUHZ01000095.1
  ref <309>: DATABASE ENTRY DATE: 2019-04-01
  ref <313>: RELEVANT RESIDUES IN SEQ ID NO: (1)..(1233)
cagtgtgaaaaactccggtggtatgagatggacccgcgttggattagctagttggcagggtaacggcctaccaaggcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgtcaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgatctgaccggactgtaatgagtcctttcccttcggggacagagaagacaggtggtgcatggttgtcgtcagctcgtgtcgtgagatgttgggttaagtcccgcaacgagcgcaacccttatcctcagtagccagcaagtgaagttgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaagg

SEQ ID NO: 1981 - DNA, 1435 bp, Blautia sp. AM47-4
  ref <308>: DATABASE ACCESSION NUMBER: NCBI ACCESSION: NZ_QUHY01000082.1
  ref <309>: DATABASE ENTRY DATE: 2019-04-01
  ref <313>: RELEVANT RESIDUES IN SEQ ID NO: (1)..(1435)
tgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccttttaggagggagctgccgaaggcgggactgataactggggtgaagtcgtaacaaggtagccgtatcggaaggtgcggctggatcacctccttctaaggaa

SEQ ID NO: 1982 - DNA, 270 bp, Blautia sp. BCRC 81119
  ref <308>: DATABASE ACCESSION NUMBER: NCBI ACCESSION: NZ_QJHD01000041.1
  ref <309>: DATABASE ENTRY DATE: 2019-04-01
  ref <313>: RELEVANT RESIDUES IN SEQ ID NO: (1)..(270)
tttatcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttgtacagggggataacagtcagaaatgactgctaataccgcataagcgcacaggaccgcatggtccggtgtgaaaaactccggtggtataagatggacccgcgttggattagctagttggt

SEQ ID NO: 1983 - DNA, 1544 bp, Blautia sp. KGMB01111
  ref <308>: DATABASE ACCESSION NUMBER: NCBI ACCESSION: NZ_SDKC01000001.1
  ref <309>: DATABASE ENTRY DATE: 2019-04-01
  ref <313>: RELEVANT RESIDUES IN SEQ ID NO: (1)..(1544)
tttatttagagagtttgatcctggctcaggatgaacgctggcggcgtgcttaacacatgcaagtcgaacgaagcacttgaaacggattcttcggatgaagtttcctgtgactgagtggcggacgggtgagtaacgcgtgggtaacctgcctcatacagggggataacagttagaaatggctgctaataccgcataagcgcacagcatcgcatgatgcagtgtgaaaaactccggtggtatgagatggacccgcgttggattagctagttggcagggtaacggcctaccaaggcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgccaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttgggtagcaaagctattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcgatctgaccggactgtaatgagtcctttcccttcggggacagagaagacaggtggtgcatggttgtcgtcagctcgtgtcgtgagatgttgggttaagtcccgcaacgagcgcaacccttatcctcagtagccagcacataaaggtgggcactctggggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaaggaaggagccgtcgaaggtgggaccgataactggggtgaagtcgtaacaaggtagccgtatcggaaggtgcggctggatcacctcctttctaaggaa

SEQ ID NO: 1984 - DNA, 640 bp, Blautia sp. KLE 1732
  ref <308>: DATABASE ACCESSION NUMBER: NCBI ACCESSION: NZ_KE993422.1
  ref <309>: DATABASE ENTRY DATE: 2019-04-01
  ref <313>: RELEVANT RESIDUES IN SEQ ID NO: (1)..(640)
ttctagtggcggacgggtgagtaacgcgtgggtaacctgccttatacagggggataacagtcagaaatgactgctaataccgcataagcgcacagagctgcatggctcggtgtgaaaaactccggtggtataagatggacccgcgttggattagctagttggtgaggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttg

SEQ ID NO: 1985 - DNA, 1539 bp, Blautia sp. Marseille-P3087
  ref <308>: DATABASE ACCESSION NUMBER: NCBI ACCESSION: NZ_LT635539.1
  ref <309>: DATABASE ENTRY DATE: 2019-04-01
  ref <313>: RELEVANT RESIDUES IN SEQ ID NO: (1)..(1539)
tttatcagagagtttgatcctggctcaggatgaacgctggcggcgtgcttaacacatgcaagtcgaacgggaaaccttttattgaagcttcggcagatttagctggtttctagtggcggacgggtgagtaacgcgtgggtaacctgccctatacagggggataacaaccagaaatggttgctaataccgcataagcgcacaggaccgcatggtccggtgtgaaaaactccggtggtataggatggacccgcgttggattagccagttggcagggtaacggcctaccaaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggattagcaagtctgatgtgaaaggcaggggctcaacccctggactgcattggaaactgccagtcttgagtgccggagaggtaagcggaattcctagtgtagcggtgaaatgcgtagatattaggaggaacaccagtggcgaaggcggcttactggacggcaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacaggggagacaggtggtgcatggttgtcgtcagctcgtgtcgtgagatgttgggttaagtcccgcaacgagcgcaacccctatccccagtagccagcagttcggctgggcactctgaggagactgccagggataacctggaggaaggcggggatgacgtcaaatcatcatgccccttatgatttgggctacacacgtgctacaatggcgtaaacaaagggaagcgagcctgcgagggtgagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgcaagggaggagctgccgaaggcgggaccgatgactggggtgaagtcgtaacaaggtagccgtatcggaaggtgcggctggatcacctcctttctagggaa

SEQ ID NO: 1986 - DNA, 1542 bp, Blautia sp. OF01-4LB; identical to SEQ ID NO: 1963
  ref <308>: DATABASE ACCESSION NUMBER: NCBI ACCESSION: NZ_QUER01000007.1
  ref <309>: DATABASE ENTRY DATE: 2019-04-01
  ref <313>: RELEVANT RESIDUES IN SEQ ID NO: (1)..(1542)

SEQ ID NO: 1987 - DNA, 1335 bp, Blautia sp. OF03-13
  ref <308>: DATABASE ACCESSION NUMBER: NCBI ACCESSION: NZ_QTVR01000055.1
  ref <309>: DATABASE ENTRY DATE: 2019-04-01
  ref <313>: RELEVANT RESIDUES IN SEQ ID NO: (1)..(1335)
ttgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaacc

SEQ ID NO: 1988 - DNA, 1190 bp, Blautia sp. OF03-15BH
  ref <308>: DATABASE ACCESSION NUMBER: NCBI ACCESSION: NZ_QSCM01000012.1
  ref <309>: DATABASE ENTRY DATE: 2019-04-01
  ref <313>: RELEVANT RESIDUES IN SEQ ID NO: (1)..(1190)
ttttttagagagtttgatcctggctcaggatgaacgctggcggcgtgcttaacacatgcaagtcgagcgaagcacttatggagattcttcggatgatccatttgtgactgagcggcggacgggtgagtaacgcgtgagtaacctgcctcatacaggggaataacagttagaaatgactgctaatgccgcataagcgcacaggaccgcatggtctggtgtgaaaaactccggtggtatgagatggactcgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctttgcaagtctgacgtgaaaatccggggctcaaccccggaactgcgttggaaactgtgaggcttgagtgccggagaggtaagcggaattcctagtgtagcggtgaaatgcgtagatattaggaggaacaccagtggcgaaggcggcttactggacggcaactgacgttgaggctcgaaagcgtggggagcaaacaggattagataccctggtagtccacgccgtaaacgatgaatactaggtgttgggggacaaagtccttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcgattcgccgggactgtaatgagtcctttcccttcggggacgaagaagacaggtggtgcatggttgtcgtcagctcgtgtcgtgagatgttgggttaagtcccgcaacgagcgcaacccttatcttcagtagccagcaagtgaagttgggcactctggagagactgccagggacaacctggaggaaggtggggatgacgtcaaat

SEQ ID NO: 1989 - DNA, 1334 bp, Blautia sp. OF09-25XD
  ref <308>: DATABASE ACCESSION NUMBER: NCBI ACCESSION: NZ_QUMG01000047.1
  ref <309>: DATABASE ENTRY DATE: 2019-04-01
  ref <313>: RELEVANT RESIDUES IN SEQ ID NO: (1)..(1334)
tgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaacc

SEQ ID NO: 1990 - DNA, 1434 bp, Blautia sp. OF11-22
  ref <308>: DATABASE ACCESSION NUMBER: NCBI ACCESSION: NZ_QUMA01000070.1
  ref <309>: DATABASE ENTRY DATE: 2019-04-01
  ref <313>: RELEVANT RESIDUES IN SEQ ID NO: (1)..(1434)
tgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccgaaaggagggagctgccgaaggcgggactgataactggggtgaagtcgtaacaaggtagccgtatcggaaggtgcggctggatcacctccttctaaggaa

SEQ ID NO: 1991 - DNA, 1543 bp, Blautia sp. OM06-15AC
  ref <308>: DATABASE ACCESSION NUMBER: NCBI ACCESSION: NZ_QULD01000006.1
  ref <309>: DATABASE ENTRY DATE: 2019-04-01
  ref <313>: RELEVANT RESIDUES IN SEQ ID NO: (1)..(1543)
tttatcagagagtttgatcctggctcaggatgaacgctggcggcgtgcttaacacatgcaagtcgagcgaagcagttaagttgatttcttcggattgattcttgactgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccgtttacggagggagctgccgaaggcgggactgataactggggtgaagtcgtaacaaggtagccgtatcggaaggtgcggctggatcacctcctttctaaggaa

SEQ ID NO: 1992 - DNA, 1539 bp, Blautia sp. OM07-19
  ref <308>: DATABASE ACCESSION NUMBER: NCBI ACCESSION: NZ_QULA01000006.1
  ref <309>: DATABASE ENTRY DATE: 2019-04-01
  ref <313>: RELEVANT RESIDUES IN SEQ ID NO: (1)..(1539)
tttatcagagagtttgatcctggctcaggatgaacgctggcggcgtgcttaacacatgcaagtcgaacgggaaacctattattgaaacttcggtcgatttaatttgtttctagtggcggacgggtgagtaacgcgtgggtaacctgccctatacagggggataacaaccagaaatggttgctaataccgcataagcgcacgggaccgcatggtccagtgtgaaaaactccggtggtataggatggacccgcgttggattagctagttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggactggcaagtctgatgtgaaaggcgggggctcaacccctggactgcattggaaactgttagtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgccgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacaggggagacaggtggtgcatggttgtcgtcagctcgtgtcgtgagatgttgggttaagtcccgcaacgagcgcaacccctatccccagtagccagcggtttggccgggcactctgaggagactgccagggataacctggaggaaggcggggatgacgtcaaatcatcatgccccttatgatttgggctacacacgtgctacaatggcgtaaacaaagggaagcgagcctgcgaaggtaagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaactgcaaagaaggagctgccgaaggcgggaccgatgactggggtgaagtcgtaacaaggtagccgtatcggaaggtgcggctggatcacctcctttctaaggaa

SEQ ID NO: 1993 - DNA, 1449 bp, Blautia sp. SG-772
  ref <308>: DATABASE ACCESSION NUMBER: NCBI ACCESSION: NZ_PXXN02000041.1
  ref <309>: DATABASE ENTRY DATE: 2019-04-01
  ref <313>: RELEVANT RESIDUES IN SEQ ID NO: (1)..(1449)
tttatttagagagtttgatcctggctcaggatgaacgctggcggcgtgcttaacacatgcaagtcgaacgaagcactttggacagattcttcggatgaagtccttagtgactgagtggcggacgggtgagtaacgcgtgggtaacctgcctcatacagggggataacagttagaaatggctgctaataccgcataagcgcacggtactgcatggtacagtgtgaaaaactccggtggtatgagatggacccgcgttggattagctagttggcagggtaacggcctaccaaggcgacgatccatagccggcctgagagggtggacggccacattgggactgagacacggcccagactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaatggcaagtctgatgtgaaaggccggggctcaaccccgggactgcattggaaactgtcaatctagagtaccggaggggtaagtggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcgatctgaccggactgtaatgagtcctttcccttcggggacagagaagacaggtggtgcatggttgtcgtcagctcgtgtcgtgagatgttgggttaagtcccgcaacgagcgcaacccttatcctcagtagccagcaagtgaagttgggcactctgtggagactgccagggataacctggaggaaggtggggatgacgtcaaatcatcatgccccttatgatttgggctacacacgtgctacaatggcgtaaacaaagggaagcgatcacgcgagtgtgagcaaatctcaaaaataacgtctcagttcggattgtagtctgcaactcgactacatgaagctggaatcgctagtaatcgcaggtcagcatactgcggtgaatacgttcccgggtcttgtacacaccgcccgtcacaccatgggagtcagtaacacccgaagccggtgacctaaccgaaagg

SEQ ID NO: 1994 - DNA, 1441 bp, Blautia sp. TF12-12AT
  ref <308>: DATABASE ACCESSION NUMBER: NCBI ACCESSION: NZ_QUKG01000035.1
  ref <309>: DATABASE ENTRY DATE: 2019-04-01
  ref <313>: RELEVANT RESIDUES IN SEQ ID NO: (1)..(1441)
ttttatcagagagtttgatcctggctcaggatgaacgctggcggcgtgcttaacacatgcaagtcgagcgaagcagttaagttgatttcttcggattgattcttaactgactgagcggcggacgggtgagtaacgcgtgggtgacctgccccataccgggggataacagctggaaacggctgctaataccgcataagcgcacagagctgcatggctcagtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaacc

SEQ ID NO: 1995 - DNA, 1334 bp, Blautia sp. TF12-31AT
  ref <308>: DATABASE ACCESSION NUMBER: NCBI ACCESSION: NZ_QUKF01000070.1
  ref <309>: DATABASE ENTRY DATE: 2019-04-01
  ref <313>: RELEVANT RESIDUES IN SEQ ID NO: (1)..(1334)
tgactgagcggcggacgggtgagtaacgcgtgggtgacctgccccataccgggggataacagctggaaacggctgctaataccgcataagcgcacagagctgcatggctcagtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaacc

SEQ ID NO: 1996 - DNA, 1515 bp, Blautia sp. TM10-2
  ref <308>: DATABASE ACCESSION NUMBER: NCBI ACCESSION: NZ_QUJZ01000008.1
  ref <309>: DATABASE ENTRY DATE: 2019-04-01
  ref <313>: RELEVANT RESIDUES IN SEQ ID NO: (1)..(1515)
ggatgaacgctggcggcgtgcttaacacatgcaagtcgagcgaagcagttaagttgatttcttcggattgattcttaactgactgagcggcggacgggtgagtaacgcgtgggtgacctgccccataccgggggataacagctggaaacggctgctaataccgcataagcgcacagagctgcatggctcggtgtgaaaaactccggtggtatgggatgggcccgcgtctgattaggcagttggcggggtaacggcccaccaaaccgacgatcagtagccggcctgagagggcgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcaaggcaagtctgatgtgaaaacccagggcttaaccctgggactgcattggaaactgtctggctcgagtgccggagaggtaagcggaattcctagtgtagcggtgaaatgcgtagatattaggaagaacaccagtggcgaaggcggcttactggacggtaactgacgttgaggctcgaaagcgtggggagcaaacaggattagataccctggtagtccacgccgtaaacgatgaatgctaggtgttggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaggtcttgacatcccgatgaccggcccgtaacggggccttctcttcggagcattggagacaggtggtgcatggttgtcgtcagctcgtgtcgtgagatgttgggttaagtcccgcaacgagcgcaacccttatcctcagtagccagcaggtaaagctgggcactctgtggagactgccagggataacctggaggaaggtggggatgacgtcaaatcatcatgccccttatgatctgggctacacacgtgctacaatggcgtaaacaaagggaggcaaagccgcgaggtggagcaaatcccaaaaataacgtctcagttcggactgcagtctgcaactcgactgcacgaagctggaatcgctagtaatcgcgaatcagaatgtcgcggtgaatacgttcccgggtcttgtacacaccgcccgtcacaccatgggagttggtaacgcccgaagtcagtgacccaaccttttaggagggagctgccgaaggcgggactgataactggggtgaagtcgtaacaaggtagccgtatcggaaggtgcggctggatcacctcctttctaaggaa

SEQ ID NO: 1997 - DNA, 1542 bp, Blautia sp. YL58
  ref <308>: DATABASE ACCESSION NUMBER: NCBI ACCESSION: NZ_CP015405.2
  ref <309>: DATABASE ENTRY DATE: 2019-04-01
  ref <313>: RELEVANT RESIDUES IN SEQ ID NO: (1)..(1542)
tttatcagagagtttgatcctggctcaggatgaacgctggcggcgtgcttaacacatgcaagtcgagcgaaacatttaagacagatccttcgggtgaagtcttatctgattgagcggcggacgggtgagtaacgcgtgggtaacctgcctcatacagggggataacagttagaaatgactgctaataccgcataagcgcacagggctgcatggcccggtgtgaaaaactccggtggtatgagatggacccgcgtctgattagctggttggaggggtaatggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgtttttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccggcccgtaacggggccttcccttcggggcagaggagacaggtggtgcatggttgtcgtcagctcgtgtcgtgagatgttgggttaagtcccgcaacgagcgcaacccctatccttagtagccagcaggtagtgccgggcactctagggagactgccggggataacccggaggaaggcggggacgacgtcaaatcatcatgccccttatgatttgggctacacacgtgctacaatggcgtaaacaaagggaagcaaagcagcgatgcctagcaaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacccaaccttataggagggagctgccgaaggcgggaccgataactggggtgaagtcgtaacaaggtagccgtatcggaaggtgcggctggatcacctcctttctaaggaa

SEQ ID NO: 1998 - DNA, 1325 bp, Blautia sp. aa 0143
  ref <308>: DATABASE ACCESSION NUMBER: NCBI ACCESSION: NZ_RCXU01000080.1
  ref <309>: DATABASE ENTRY DATE: 2019-04-01
  ref <313>: RELEVANT RESIDUES IN SEQ ID NO: (1)..(1325)
cggtgtgaaaaactccggtggtataagatggacccgcgttggattagctagttggtgaggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggatggacaagtctgatgtgaaaggctggggctcaaccccgggactgcattggaaactgcccgtcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatgctaggtgtcggggagcaaagctcttcggtgccgccgcaaacgcattaagcattccacctggggagtacgttcgcaagaatgaaactcaaaggaattgacggggacccgcacaagcggtggagcatgtggtttaattcgaagcaacgcgaagaaccttaccaagtcttgacatccctctgaccgactcttaaccgagtctttccttcgggacagaggagacaggtggtgcatggttgtcgtcagctcgtgtcgtgagatgttgggttaagtcccgcaacgagcgcaacccctatcctcagtagccagcggttcggccgggcactctggggagactgccagggataacctggaggaaggcggggatgacgtcaaatcatcatgccccttatgatttgggctacacacgtgctacaatggcgtaaacaaagggaagcgaacctgcgagggtgggcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagtaacgcccgaagtcagtgacctaaccgcaaggaaggagctgccgaaggcgggaccgatgactggggtgaagtcgtaacaaggtagccgtatcggaaggtgcggctggatcacctcctttctaaggaa

SEQ ID NO: 1999 - DNA, 976 bp, Blautia wexlerae
  ref <308>: DATABASE ACCESSION NUMBER: NCBI ACCESSION: NZ_CYZN01000013.1
  ref <309>: DATABASE ENTRY DATE: 2019-04-01
  ref <313>: RELEVANT RESIDUES IN SEQ ID NO: (1)..(976)
tttatcagagagtttgatcctggctcaggatgaacgctggcggcgtgcttaacacatgcaagtcgaacgggaattactttattgaaacttcggtcgatttaatttaattctagtggcggacgggtgagtaacgcgtgggtaacctgccttatacagggggataacagtcagaaatggctgctaataccgcataagcgcacagagctgcatggctcagtgtgaaaaactccggtggtataagatggacccgcgttggattagcttgttggtggggtaacggcccaccaaggcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagatagtgacggtacctgactaagaagccccggctaactacgtgccagcagccgcggtaatacgtagggggcaagcgttatccggatttactgggtgtaaagggagcgtagacggtgtggcaagtctgatgtgaaaggcatgggctcaacctgtggactgcattggaaactgtcatacttgagtgccggaggggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcagagccattcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaa

SEQ ID NO: 2000 - DNA, 1534 bp, Bogoriella caseilytica
  ref <308>: DATABASE ACCESSION NUMBER: NCBI ACCESSION: NZ_RKHK01000001.1
  ref <309>: DATABASE ENTRY DATE: 2019-04-01
  ref <313>: RELEVANT RESIDUES IN SEQ ID NO: (1)..(1534)
cggagagtttgatcctggctcaggacgaacgctggcggcgtgcttaacacatgcaagtcgaacgatgatgcccagcttgctgggtggattagtggcgaacgggtgagtaacacgtgagtaacctgcccctgacttcgggataagcgctggaaacggcgtctaataccggatacgacctacctccgcatggtgtgtgggtggaaagcttgatgcggttggggatgggctcgcggcctatcagcttgttggtggggtgaaggcctaccaaggcgacgacgggtagccggcctgagagggtgtccggccacactgggactgagacacggcccagactcctacgggaggcagcagtggggaatattgcacaatgggcgcaagcctgatgcagcgacgccgcgtgagggatgacggccttcgggttgtaaacctctttcagtagggaacaagccttcgggtgagggtacctgcagaagaagcgccggctaactacgtgccagcagccgcggtaatacgtagggcgcaagcgttgtccggaattattgggcgtaaagagctcgtaggcggcttgtcgcgtctgctgtgaaaacccggggctcaaccccgggcctgcagtgggtacgggcaggctagagtgcggtaggggagactggaattcctggtgtagcggtggaatgcgcagatatcaggaggaacaccgatggcgaaggcaggtctctgggccgttactgacgctgaggagcgaaagcatggggagcgaacaggattagataccctggtagtccatgccgtaaacgttgggcactaggtgtggggtctgtttccacggagtccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacataacctggaagcattcagagatgggtgtgcctttacgggccgggttacaggtggtgcatggttgtcgtcagctcgtgtcgtgagatgttgggttaagtcccgcaacgagcgcaacccttgtcctgtgttgccagcacgtagtggtggggactcatgggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggatcagggtctgcaactcgaccctgtgaagtcggagtcgctagtaatcgcagatcagcaacgctgcggtgaatacgttctcgggccttgtacacaccgcccgtcacgtcacgaaagtcggtaacacccgaagctcatggcccaaccggttcttccggggggagtggtcgaaggtgggactggcgattgggacgaagtcgtaacaaggtagccgtaccggaaggtgcggctggatcacctcctttctaagga

SEQ ID NO: 2001 - DNA, 1490 bp, Bombella intestini
  ref <308>: DATABASE ACCESSION NUMBER: NCBI ACCESSION: NZ_JATM01000010.1
  ref <309>: DATABASE ENTRY DATE: 2019-04-01
  ref <313>: RELEVANT RESIDUES IN SEQ ID NO: (1)..(1490)
tgaacctgagagtttgatcctggctcagagcgaacgctggcggcatgcttaacacatgcaagtcgcacgaatctttcgggattagtggcggacgggtgagtaacgcgtaggaacctatccagaggtgggggataacatcgggaaactggtgctaataccgcatgatgcctgagggccaaaggagcaattcgccattggaggggcctgcgttcgattagctagttggttaggtaaaggctgaccaaggcgatgatcgatagctggtttgagaggatgatcagccacactgggactgagacacggcccagactcctacgggaggcagcagtggggaatattggacaatgggggcaaccctgatccagcaatgccgcgtgtgtgaagaaggtcttcggattgtaaagcactttcactagggaagatgatgacggtacctagagaagaagccccggctaacttcgtgccagcagccgcggtaatacgaagggggctagcgttgctcggaatgactgggcgtaaagggcgcgtaggctgtttgtacagtcagatgtgaaatccccgggcttaacctgggaactgcatttgatacgtgcagactagagtccgagagagggttgtggaattcccagtgtagaggtgaaattcgtagatattgggaagaacaccggttgcgaaggcggcaacctggctcggaactgacgctgaggcgcgaaagcgtggggagcgaacaggattagataccctggtagtccacgctgtaaacgatgtgtgctggatgttgggtaattttattactcagtgtcggagctaacgcgttaagcacaccgcctggggagtacggccgcaaggttgaaactcaaaggaattgacgggggcccgcacaagcggtggagcatgtggtttaattcgaagcaacgcgcagaaccttaccagggcttgcatggggaggctgtattcagagatggatatttcttcggacctcccgcacaggtgctgcatggctgtcgtcagctcgtgtcgtgagatgttgggttaagtcccgcaacgagcgcaacccttgtctttagttgccatcacgtttgggtgggcactctagagagactgccggtgacaagccggaggaaggtggggatgacgtcaagtcctcatggcccttatgtcctgggctacacacgtgctacaatggcggtgacagagggatgctacatggtgacatggtgctgatctcaaaaaaccgtctcagttcggattgtactctgcaactcgagtgcatgaaggtggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaagg

SEQ ID NO: 2002 - DNA, 1536 bp, Bordetella avium
  ref <308>: DATABASE ACCESSION NUMBER: NCBI ACCESSION: NZ_UFTG01000001.1
  ref <309>: DATABASE ENTRY DATE: 2019-04-01
  ref <313>: RELEVANT RESIDUES IN SEQ ID NO: (1)..(1536)
agattaaactgaagagtttgatcctggctcagattgaacgctggcgggatgctttacacatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcgggggaccttcgggcctcgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaaaggcgcaggctaataccttgcgcaaatgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 2003 - DNA, 1536 bp, Bordetella bronchiseptica
  ref <308>: DATABASE ACCESSION NUMBER: NCBI ACCESSION: NZ_LR134480.1
  ref <309>: DATABASE ENTRY DATE: 2019-04-01
  ref <313>: RELEVANT RESIDUES IN SEQ ID NO: (1)..(1536)
agattgaactgaagagtttgatcctggctcagattgaacgctggcgggatgctttacacatgcaagtcggacggcagcacgggcttcggcctggtggcgagtggcgaacgggtgagtaatgtatcggaacgtgcccagtagcgggggataactacgcgaaagcgtggctaataccgcatacgccctacgggggaaagcgggggaccttcgggcctcgcactattggagcggccgatatcggattagctagttggtggggtaacggcctaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 2004 - DNA, 1536 bp, Bordetella hinzii
  ref <308>: DATABASE ACCESSION NUMBER: NCBI ACCESSION: NZ_LR134382.1
  ref <309>: DATABASE ENTRY DATE: 2019-04-01
  ref <313>: RELEVANT RESIDUES IN SEQ ID NO: (1)..(1536)
agattgaactgaagagtttgatcctggctcagattgaacgctggcgggatgctttacacatgcaagtcggacggcagcacgggcttcggcctggtggcgagtggcgaacgggtgagtaatgtatcggaacgtgcccagtagcgggggataactacgcgaaagcgtagctaataccgcatacgccctacgggggaaagcgggggaccttcgggcctcgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggcgcaggctaatatcttgcgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 2005 - DNA, 1537 bp, Bordetella holmesii
  ref <308>: DATABASE ACCESSION NUMBER: NCBI ACCESSION: NZ_UFTX01000001.1
  ref <309>: DATABASE ENTRY DATE: 2019-04-01
  ref <313>: RELEVANT RESIDUES IN SEQ ID NO: (1)..(1537)
agattaaactgaagagtttgatcctggctcagattgaacgctggcgggatgctttacacatgcaagtcggacggcagcacggggcttcggcctggtggcgagtggcgaacgggtgagtaatgtatcggaacgtgcccggtagcgggggataactacgcgaaagcgtggctaataccgcatacgccctacgggggaaagcgggggaccttcgggcctcgcactattggagcggccgatatcggattagctagttggtggggtaacggcctaccaaggcgacgatccgtagctggtttgagaggacgaccagtcacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggcacgggctaatatcctgtgcaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagtgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaacccgcgagggggagccaatcccagaaacccggtcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 2006 - DNA, 1536 bp, Bordetella parapertussis; identical to SEQ ID NO: 2003
  ref <308>: DATABASE ACCESSION NUMBER: NCBI ACCESSION: NZ_LR134329.1
  ref <309>: DATABASE ENTRY DATE: 2019-04-01
  ref <313>: RELEVANT RESIDUES IN SEQ ID NO: (1)..(1536)

SEQ ID NO: 2007 - DNA, 1540 bp, Bordetella sp. J329
  ref <308>: DATABASE ACCESSION NUMBER: NCBI ACCESSION: NZ_CP021250.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctagcgggatgctttacacatgcaagtcgaacggcagcacgaggagcttgctccttggtggcgagtggcgaacgggtgagtaatatatcggaacatgcccagtagcgggggataactactcgaaagagtggctaataccgcatacgtcctacgggagaaagcaggggaccttcgggccttgcactattggagtggccgatatcggattagctagttggtggggtaaaggcctaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttgtcaggaaagaaatcgcccgggataatacctcgggtggatgacggtacctgaagaataagcaccggctaactacgtgccagcagccgcggtaatacgtagggtgcaagcgttaatcggaattactgggcgtaaagcgtgcgcaggcggttcggaaagaaagatgtgaaatcccagggcttaaccttggaactgcatttttaactaccgggctagagtgtgtcagaggggggtggaattccgcgtgtagcagtgaaatgcgtagatatgcggaggaacaccgatggcgaaggcagccccctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaaaccgcgaggtggagctaatctcagaaacccgatcgtagtccggattgtagtctgcaactcgactacatgaagtcggaatcgctagtaatcgcggatcagaatgtcgcggtgaatacgttcccgggtcttgtacacaccgcccgtcacaccatgggagtgggttctaccagaagtagttagcctaaccgcaaggagggcgattaccacggtaggattcatgactggggtgaagtcgtaacaaggtagccgtatcggaaggtgcggctggatcacctccttt

SEQ ID NO: 2008 - DNA, 1536 bp, Bordetella trematum
  ref <308>: DATABASE ACCESSION NUMBER: NCBI ACCESSION: NZ_UFUJ01000001.1
  ref <309>: DATABASE ENTRY DATE: 2019-04-01
  ref <313>: RELEVANT RESIDUES IN SEQ ID NO: (1)..(1536)
agattaaactgaagagtttgatcctggctcagattgaacgctggcgggatgctttacacatgcaagtcggacggcagcacggacttcggtctggtggcgagtggcgaacgggtgagtaatgtatcggaacgtgcccagtagcgggggataactacgcgaaagcgtggctaataccgcatacgccctacgggggaaagcgggggaccttcgggcctcgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggcaaccctgatccagccatcccgcgtgtgcgatgaaggccttcgggttgtaaagcacttttggcaggaaagaaacggcgccagctaatacctggcgctaatgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatcccgaagagatttgggagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggttgccaacccgcgagggggagccaatctcagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgattaccacggtaggattcatgactggggtgaagtcgtaacaaggtagccgtatcggaaggtgcggctggatcacctccttt

SEQ ID NO: 2009 - DNA, 1544 bp, Borrelia miyamotoi
  ref <308>: DATABASE ACCESSION NUMBER: NCBI ACCESSION: NZ_CP021872.1
  ref <309>: DATABASE ENTRY DATE: 2019-04-01
  ref <313>: RELEVANT RESIDUES IN SEQ ID NO: (1)..(1544)
aaaaataacgaagagtttgatcctggcttagaactaacgctggcagtgcgtcttaagcatgcaagtcagacggaatgtagtaatacattcagtggcgaacgggtgagtaacgcgtggataatctacctacgagatggggataactattagaaatagtagctaataccgaataaagtcaattgaggtgttgattgatgaaaggaagcctttaaagcttcgcttgtagatgagtctgcgtcttattagttagttggtggggtaagagcctaccaaggctatgataagtaaccggcctgagagggtgatcggtcacactggaactgagatacggtccagactcctacgggaggcagcagctaagaatcttccgcaatgggctaaagcctgacggagcgacactgcgtgaacgaagaaggtcgaaagattgtaaagttcttttataagtgaggaataagctttgtaggaaatgacaaagcgatgacgttaatttatgaataagccccggctaattacgtgccagcagccgcggtaatacgtaaggggcgagcgttgttcgggatcattgggcgtaaagggtgagtaggcggatatgcaagtctatgtgtaaaataccacagctcaactgtggaactatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcaaacaggattagataccctggtagtctacgctgtaaacgatgcacacttggtgttaatcgaaaggttagtaccgaagctaacgtgttaagtgtgccgcctggggagtatgttcgcaagaatgaaactcaaaggaattgacgggggcccgcacaagcggtggagcatgtggtttaattcgatgatacgcgaggaaccttaccagggcttgacatatacaggatatagttagagataactattccccgtttggggtctgtatacaggtgctgcatggttgtcgtcagctcgtgccgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaaacagtgatgtgaagcaaaacgcagaaagcaggtctcagtccagattgaagtctgaaactcggcttcatgaagttggaatcgctagtaatcgtatatcagaatgatacggtgaatacgttctcgggccttgtacacaccgcccgtcacaccacccgagttgaggatacccgaagctattattctaacccgcaaggggggaaggtatctaaggtatgtttagtgaggggggtgaagtcgtaacaaggtagccgtactggaaagtgtggctggatcacctcctttcta

SEQ ID NO: 2010 - DNA, 1544 bp, Borrelia turcica
  ref <308>: DATABASE ACCESSION NUMBER: NCBI ACCESSION: NZ_CP028884.1
  ref <309>: DATABASE ENTRY DATE: 2019-04-01
  ref <313>: RELEVANT RESIDUES IN SEQ ID NO: (1)..(1544)
aaaaataacgaagagtttgatcctggcttagaactaacgctggcagtgcgtcttaagcatgcaagtcaaacgggatgtagcaatacattcagtggcgaacgggtgagtaacgcgtggataatctacctatgagatggggataactattagaaatagtagctaataccgaataaggtcaattgagatgttaattgatgaaaggaagcctttaaagcttcgcttgtagatgagtctgcgtcttattagctagttggtagggtaaaggcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaatgatgaaggtcgaaagattgtaaagttcttttataaatgaggaataagctttgtaggaaatgacagagtgatgacgttaatttaggaataagccccggctaattacgtgccagcagccgcggtaatacgtaaggggcgagcgttgttcgggattattgggcgtaaagggtgagtaggcggatatgcaagtctatgcgtaaaataccacagctcaactgtggagctatgctggaaactgcatgtctagagtctgataggggaagttagaattcctggtgtaagggtggaatctgttgatatcaggaagaataccagaggcgaaggcgaacttctgggtcaagactgacgctgagtcacgaaagcgtagggagcaaacaggattagataccctggtagtctacgctgtaaacgatgcacacttggtgttaactgaaaggttggtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatggttagagataactattccccgtttggggtctatatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtgaggatgacgtcaaatcatcatggcccttatgtcctgggctacacacgtgctacaatggcctgtacaaagcgatgcgaagcagtgatgtgaagcaaaacgcataaagcaggtctcagtccagattgaagtctgcaactcgacttcatgaagttggaatcgctagtaatcgtatatcagaatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgcggctggatcacctcctttcta

SEQ ID NO: 2011 - DNA, 1544 bp, Borrelia turicatae
  ref <308>: DATABASE ACCESSION NUMBER: NCBI ACCESSION: NZ_CP015629.1
  ref <309>: DATABASE ENTRY DATE: 2019-04-01
  ref <313>: RELEVANT RESIDUES IN SEQ ID NO: (1)..(1544)
aaaaataacgaagagtttgatcctggcttagaactaacgctggcagtgcgtcttaagcatgcaagtcagacggaatgtagcaatacattcagtggcgaacgggtgagtaacgcgtggataatctacctatgagatggggataactattagaaatagtagctaataccgaataaggtcaattgagatgttaattgatgaaaggaagcctttaaagcttcgcttgtagatgagtctgcgtcttattagctagttggtagggtaagagcctaccaaggctatgataagtaaccggcctgagagggtgaacggtcacactggaactgagatacggtccagactcctacgggaggcagcagctaagaatcttccgcaatgggcgaaagcctgacggagcgacactgcgtgaacgaagaaggtcgaaagattgtaaagttcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgtaagtctatgcgtaaaataccacagctcaactgtggaactatgctggaaactgcatgactagagtctgataggggaagttagaattcctggtgtaagggtggaatctgttgatatcaggaagaataccagaggcgaaggcgaacttctaggtcaagactgacgctgagtcacgaaagcgtagggagcgaacaggattagataccctggtagtctacgctgtaaacgatgcacacttggtgttaatcgaaaggttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatacaggatgtagttagagataactattccccgtttggggtctgtatacaggtgctgcatggttgtcgtcagctcgtgctgtgaggtgttgggttaagtcccgcaacgagcgcaacccttattgtctgttaccagcatgtaaagatggggactcagacgagactgccggtgataagccggaggaaggtggggatgacgtcaaatcatcatggcccttatgtcctgggctacacacgtgctacaatggcctgtacaaagcgatgcgaaacagtgatgtgaagcaaaacgcataaagcaggtctcagtccagattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgcaagggaggaaggtatctaaggtatgtttagtgaggggggtgaagtcgtaacaaggtagccgtactggaaagtgtggctggatcacctcctttcta

SEQ ID NO: 2012 - DNA, 1541 bp, Borreliella bavariensis
  ref <308>: DATABASE ACCESSION NUMBER: NCBI ACCESSION: NZ_CP028872.1
  ref <309>: DATABASE ENTRY DATE: 2019-04-01
  ref <313>: RELEVANT RESIDUES IN SEQ ID NO: (1)..(1541)
aaataacgaagagtttgatcctggcttagaactaacgctggcagtgcgtcttaagcatgcaagtcaaacgggatgtagcaatacatctagtggcgaacgggtgagtaacgcgtggatgatctacctacgagatggggataactattagaaatagtagctaataccgaataaagtcaattaatttgttgattgatgaaaggaagcctttaaagcttcgcttgtagatgagtctgcgtcttattagttagttggtagggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacgaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggaactatgttagaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttcta

SEQ ID NO: 2013 - DNA, 1545 bp, Borreliella burgdorferi
  ref <308>: DATABASE ACCESSION NUMBER: NCBI ACCESSION: NZ_CP031412.1
  ref <309>: DATABASE ENTRY DATE: 2019-04-01
  ref <313>: RELEVANT RESIDUES IN SEQ ID NO: (1)..(1545)
aataaaataacgaagagtttgatcctggcttagaactaacgctggcagtgcgtcttaagcatgcaagtcaaacgggatgtagcaatacattcagtggcgaacgggtgagtaacgcgtggatgatctacctatgagatggggataactattagaaatagtagctaataccgaataaggtcagttaatttgttaattgatgaaaggaagcctttaaagcttcgcttgtagatgagtctgcgtcttattagctagttggtagggtaaatgcctaccaaggcaatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggacctatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttcta

SEQ ID NO: 2014 - DNA, 1545 bp, Borreliella finlandensis
  ref <308>: DATABASE ACCESSION NUMBER: NCBI ACCESSION: NZ_ABJZ02000005.1
  ref <309>: DATABASE ENTRY DATE: 2019-04-01
  ref <313>: RELEVANT RESIDUES IN SEQ ID NO: (1)..(1545)
aataaaataacgaagagtttgatcctggcttagaactaacgctggcagtgcgtcttaagcatgcaagtcaaacgggatgtagcaatacattcagtggcgaacgggtgagtaacgcgtggatgatctacctatgagatggggataactattagaaatagtagctaataccgaataaggtcaattaatttgttaattgatgaaaggaagcctttaaagcttcgcttgtagatgagtctgcgtcttattagctagttggtagggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggacctatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttcta

SEQ ID NO: 2015 - DNA, 1543 bp, Borreliella garinii
  ref <308>: DATABASE ACCESSION NUMBER: NCBI ACCESSION: NZ_CP028861.1
  ref <309>: DATABASE ENTRY DATE: 2019-04-01
  ref <313>: RELEVANT RESIDUES IN SEQ ID NO: (1)..(1543)
aagaataacgaagagtttgatcctggcttagaactaacgctggcagtgcgtcttaagcatgcaagtcaaacgggatgtagcaatacatctagtggcgaacgggtgagtaacgcgtggatgatctacctacgagatggggataactattagaaatagtagctaataccgaataaagtcaattaatttgttaattgatgaaaggaagcctttaaagcttcgcttgtagatgagtctgcgtcttattagctagttggtagggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaagtgatgacgttaatttatgaataagccccggctaattacgtgccagcagccgcggtaatacgtaaggggcgagcgttgttcgggattattgggcgtaaagggtgagtaggcggatatataagtctatgcataaaataccacggctcaactgtggaactatgttggaaactatatgtctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttcta

SEQ ID NO: 2016 - DNA, 1542 bp, Borreliella japonica
  ref <308>: DATABASE ACCESSION NUMBER: NCBI ACCESSION: NZ_FMTE01000002.1
  ref <309>: DATABASE ENTRY DATE: 2019-04-01
  ref <313>: RELEVANT RESIDUES IN SEQ ID NO: (1)..(1542)
aagaataacgaagagtttgatcctggcttagaactaacgctggcagtgcgtcttaagcatgcaagtcaaacgagatgtagcaatacatttagtggcgaacgggtgagtaacgcgtggatgatctacctacgagatggggataactactagaaatagtagctaataccgaataaggtcaattaatttgttaattgatgaaaggaagccttaaagcttcgcttgtagatgagtctgcgtcttattagttagttggtagggtaaatgcctaccaagacaatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatgtaagtctatgcataaaataccacagctcaactgtggagctatgttggaaactgtatatctagagtctgatagaggaagttagaatttctggtgtaagggtggaatctgttgatatcagaaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgcgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatggtggggactcagataagactgccggtgataagtcggaggaaggtgaggatgacgtcaaatcatcatggcccttatgtcctgggctacacacgtgctacaatggcctgtacaaagcgaagcgaagcagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttcta

SEQ ID NO: 2017 - DNA, 1543 bp, Borreliella spielmanii
  ref <308>: DATABASE ACCESSION NUMBER: NCBI ACCESSION: NZ_ABKB02000009.1
  ref <309>: DATABASE ENTRY DATE: 2019-04-01
  ref <313>: RELEVANT RESIDUES IN SEQ ID NO: (1)..(1543)
aagaataacgaagagtttgatcctggcttagaactaacgctggcagtgcgtcttaagcatgcaagtcaaacgggatgtagcaatacatctagtggcgaacgggtgagtaacgcgtggatgatctacctatgagatggggataactactagaaatagtagctaataccgaataaggtcaattaatttgttaattgatgaaaggaagcctttaaagcttcgcttgtagatgagtctgcgtcttattagttagttggtggggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacaaggtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggaactatgttggaaactatatgtctagagtctgatagaggaagttagaattcctggtgtaagggtggaatctgttgatatcaggaagaataccggaggcgaaggcgaacttctgggtcaagactgacgctgagtcacgaaagcgtagggagcaaacaggattagataccctggtagtctacgctgtaaacgatgcacacttggtgttaactaaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggcctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcacaaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttcta

SEQ ID NO: 2018 - DNA, 1543 bp, Borreliella valaisiana
  ref <308>: DATABASE ACCESSION NUMBER: NCBI ACCESSION: NZ_CP009117.1
  ref <309>: DATABASE ENTRY DATE: 2019-04-01
  ref <313>: RELEVANT RESIDUES IN SEQ ID NO: (1)..(1543)
aagaataacgaagagtttgatcctggcttagaactaacgctggcagtgcgtcttaagcatgcaagtcaaacgggatgtagtaatacatctagtggcgaacgggtgagtaacgcgtggatgatctacctatgagatggggataactactagaaatagtggctaataccgaataaggtcaattaatttgttaattgatgaaaggaagcctttaaagcttcgcttgtagatgagtctgcgtcttattagttagttggtggggtaaatgcctaccaaggcgatgataagtaaccggcctgagagggtgaacggtcacactggaactgagatacggtccagactcctacgggaggcagcagctaagaatcttccgcaatgggcgaaagcctgacggagcgacactgcgtgaatgaagaaggtcgaaagattgtaaaattcttttataaatgaggaataagctttgtaggaaatgacagagtgatgacgttaatttatgaataagccccggctaattacgtgccagcagccgcggtaatacgtaaggggcgagcgttgttcgggattattgggcgtaaagggtgagtaggcggatatataagtctatgcataaaataccacagctcaactgtggaactatgttggaaactatatgtctagagtctgatagaggaagttagaattcctggtgtaagggtggaatctgttgatatcaggaagaataccggaggcgaaggcgaacttctgggtcaagactgacgctgagtcacgaaagcgtagggagcaaacaggattagataccctggtagtctacgctgtaaacgatgcacacttggtgttaactgaaagttagtaccgaagctaacgtgttaagtgtgccgcctggggagtatgctcgcaagagtgaaactcaaaggaattgacgggggcccgcacaagcggtggagcatgtggtttaattcgatgatacgcgaggaaccttaccagggcttgacatatataggatatagttagagataattattccccgtttggggtctatatacaggtgctgcatggttgtcgtcagctcgtgctgtgaggtgttgggttaagtcccgcaacgagcgcaacccttgttatctgttaccagcatgtaatgatggggactcagataagactgccggtgataagtcggaggaaggtgaggatgacgtcaaatcatcatggcccttatgtcctgggctacacacgtgctacaatggcctgtacaaagcgaagcgaaacagtgatgtgaagcaaaacgcataaagcaggtctcagtccggattgaagtctgaaactcgacttcatgaagttggaatcgctagtaatcgtatatcagaatgatacggtgaatacgttctcgggccttgtacacaccgcccgtcacaccacccgagttgaggatacccgaagctattattctaacccgtaagggaggaaggtatttaaggtatgtttagtgaggggggtgaagtcgtaacaaggtagccgtactggaaagtgcggctggatcacctcctttcta

SEQ ID NO: 2019 - DNA, 1494 bp, Bosea lathyri
  ref <308>: DATABASE ACCESSION NUMBER: NCBI ACCESSION: NZ_FNUY01000023.1
  ref <309>: DATABASE ENTRY DATE: 2019-04-01
  ref <313>: RELEVANT RESIDUES IN SEQ ID NO: (1)..(1494)
caatctgagagtttgatcctggctcagagcgaacgctggcggcaggcttaacacatgcaagtcgaacgggtatcttcggatactagtggcagacgggtgagtaacacgtgggaacgtacctttcggttcggaataatacagggaaacttgtactaataccggataagcccttcgggggaaagatttatcgccgatagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgaaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgaggaacagagatgtacctcttcagttcggctggccggaacacaggtgctgcatggctgtcgtcagctcgtgtcgtgagatgttgggttaagtcccgcaacgagcgcaaccctcgcccctagttgccatcattaagttgggaactctagggggactgccggtgataagccgcgaggaaggtggggatgacgtcaagtcctcatggcccttacaggctgggctacacacgtgctacaatggcggtgacaatgggcagcgaaagagcgatctggagctaatctcaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaag

SEQ ID NO: 2020 - DNA, 1493 bp, Bosea minatitlanensis
ttcaatctgagagtttgatcctggctcagagcgaacgctggcggcaggcttaacacatgcaagtcgaacgggcacttcggtgctagtggcagacgggtgagtaacgcgtgggaacgtgcctttcggttcggaataattcagggaaacttggactaataccggatacgcccttcgggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgggagtcttgagttcggaagaggttggtggaactgcgagtgtagaggtgaaattcgtagatattcgcaagaacaccggtggcgaaggcggccaactggtccgaaactgacgctgaggcgcgaaagcgtggggagcaaacaggattagataccctggtagtccacgccgtaaacgatgaatgccagccgttggggagcttgctcttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggggcgacctggagctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaa

SEQ ID NO: 2021 - DNA, 1494 bp, Bosea sp. 1131
  ref <308>: DATABASE ACCESSION NUMBER: NCBI ACCESSION: NZ_PQFZ01000043.1
  ref <309>: DATABASE ENTRY DATE: 2019-04-01
  ref <313>: RELEVANT RESIDUES IN SEQ ID NO: (1)..(1494)
caatctgagagtttgatcctggctcagagcgaacgctggcggcaggcttaacacatgcaagtcgaacgggtatcttcggatactagtggcagacgggtgagtaacacgtgggaacgtacctttcggttcggaataattcagggaaacttggactaataccggataagcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggacttttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgaggaacagagatgtacctcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaag

SEQ ID NO: 2022 - DNA, 1499 bp, Bosea sp. 117
  ref <308>: DATABASE ACCESSION NUMBER: NCBI ACCESSION: NZ_JNLC01000015.1
  ref <309>: DATABASE ENTRY DATE: 2019-04-01
  ref <313>: RELEVANT RESIDUES IN SEQ ID NO: (1)..(1499)
tcattcaacttgagagtttgatcctggctcagaacgaacgctggcggcaggcttaacacatgcaagtcgaacgcgctcttcggagcgagtggcagacgggtgagtaacacgtggggatctgcccaatggtgcggaataactcagggaaacttgagctaataccgcatgtgcccgcaaggggaaagatttatcgccattggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcgccgacgaagataatgacggtagtcggagaagaagccccggctaacttcgtgccagcagccgcggtaatacgaagggggctagcgttgttcggaatcactgggcgtaaagcgcacgtaggcggattgttaagtcaggggtgaaagcctggagctcaactccagaactgcccttgatactggcaatctcgagtccggaagaggtaagtggaactccgagtgtagaggtgaaattcgtagatattcggaagaacaccagtggcgaaggcggcttactggtccggtactgacgctgaggtgcgaaagcgtggggagcaaacaggattagataccctggtagtccacgccgtaaacgatggaggctagccgttggcaagcatgcttgtcagtggcgcagctaacgcattaagcctcccgcctggggagtacggtcgcaagattaaaactcaaaggaattgacgggggcccgcacaagcggtggagcatgtggtttaattcgaagcaacgcgcagaaccttaccagcctttgacatgccctggacagttaccagagatggtttcttctcttcggagccggggacacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggcggtgacagtgggatgcgaacccgcgagggtgagcaaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctcctttctaagga

SEQ ID NO: 2023 - DNA, 1491 bp, Bosea sp. 124
  ref <308>: DATABASE ACCESSION NUMBER: NCBI ACCESSION: NZ_PZZM01000001.1
  ref <309>: DATABASE ENTRY DATE: 2019-04-01
  ref <313>: RELEVANT RESIDUES IN SEQ ID NO: (1)..(1491)
caatctgagagtttgatcctggctcagagcgaacgctggcggcaggcttaacacatgcaagtcgaacgggtatcttcggatactagtggcagacgggtgagtaacacgtgggaacgtacctttcggttcggaataatacagggaaacttgtactaataccggatacgcccttcgggggaaagatttatcgccgatagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggacttttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttct

SEQ ID NO: 2024 - DNA, 1503 bp, Bosea sp. AAP35
  ref <308>: DATABASE ACCESSION NUMBER: NCBI ACCESSION: NZ_LJHQ01000066.1
  ref <309>: DATABASE ENTRY DATE: 2019-04-01
  ref <313>: RELEVANT RESIDUES IN SEQ ID NO: (1)..(1503)
atacaatctgagagtttgatcctggctcagagcgaacgctggcggcaggcttaacacatgcaagtcgaacgggcacttcggtgctagtggcagacgggtgagtaacacgtgggaacgtacctttcggttcggaataatacagggaaacttgtactaataccggatacgcccttcgggggaaagatttatcgccgatagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgaaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggacttttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 2025 - DNA, 1501 bp, Bosea sp. BIWAKO-01
  ref <308>: DATABASE ACCESSION NUMBER: NCBI ACCESSION: NZ_BCQA01000001.1
  ref <309>: DATABASE ENTRY DATE: 2019-04-01
  ref <313>: RELEVANT RESIDUES IN SEQ ID NO: (1)..(1501)
tcatccaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggataagcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagagcgatctggagctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2026 - DNA, 1495 bp, Bosea sp. CF476
  ref <308>: DATABASE ACCESSION NUMBER: NCBI ACCESSION: NZ_QKMI01000026.1
  ref <309>: DATABASE ENTRY DATE: 2019-04-01
  ref <313>: RELEVANT RESIDUES IN SEQ ID NO: (1)..(1495)
ctcatcaaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttct

SEQ ID NO: 2027 - DNA, 1491 bp, Bosea sp. FBZP-16
  ref <308>: DATABASE ACCESSION NUMBER: NCBI ACCESSION: NZ_LNCQ01000012.1
  ref <309>: DATABASE ENTRY DATE: 2019-04-01
  ref <313>: RELEVANT RESIDUES IN SEQ ID NO: (1)..(1491)
aatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaag

SEQ ID NO: 2028 - DNA, 1501 bp, Bosea sp. LC85
  ref <308>: DATABASE ACCESSION NUMBER: NCBI ACCESSION: NZ_JPKG01000062.1
  ref <309>: DATABASE ENTRY DATE: 2019-04-01
  ref <313>: RELEVANT RESIDUES IN SEQ ID NO: (1)..(1501)
tcatccaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggataagccctccgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagagcgatctggagctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2029 - DNA, 1499 bp, Bosea sp. Leaf344
  ref <308>: DATABASE ACCESSION NUMBER: NCBI ACCESSION: NZ_LMRT01000007.1
  ref <309>: DATABASE ENTRY DATE: 2019-04-01
  ref <313>: RELEVANT RESIDUES IN SEQ ID NO: (1)..(1499)
atacaatctgagagtttgatcctggctcagagcgaacgctggcggcaggcttaacacatgcaagtcgaacgggcacttcggtgctagtggcagacgggtgagtaacacgtgggaacgtaccttttggttcggaataattcagggaaacttggactaataccggatacgcccttcgggggaaagatttatcgccgaaagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggacttttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagagcgatctggagctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2030 - DNA, 1502 bp, Bosea sp. PAMC 26642
  ref <308>: DATABASE ACCESSION NUMBER: NCBI ACCESSION: NZ_CP014301.1
  ref <309>: DATABASE ENTRY DATE: 2019-04-01
  ref <313>: RELEVANT RESIDUES IN SEQ ID NO: (1)..(1502)
caatctgagagtttgatcctggctcagagcgaacgctggcggcaggcttaacacatgcaagtcgaacgggtatcttcggatactagtggcagacgggtgagtaacacgtgggaacgtacctttcggttcggaataattcagggaaacttggactaataccggataagcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgaggaacagagatgtacctcttcagttcggctggccggaacacaggtgctgcatggctgtcgtcagctcgtgtcgtgagatgttgggttaagtcccgcaacgagcgcaaccctcgcccctagttgccatcattaagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 2031 - DNA, 1503 bp, Bosea sp. RAC05
  ref <308>: DATABASE ACCESSION NUMBER: NCBI ACCESSION: NZ_CP016464.1
  ref <309>: DATABASE ENTRY DATE: 2019-04-01
  ref <313>: RELEVANT RESIDUES IN SEQ ID NO: (1)..(1503)
atacaatctgagagtttgatcctggctcagagcgaacgctggcggcaggcttaacacatgcaagtcgaacgggcacttcggtgctagtggcagacgggtgagtaacacgtgggaacgtacctttcggttcggaataatacagggaaacttgtactaataccggatacgcccttcgggggaaagatttatcgccgattgatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 2032 - DNA, 1503 bp, Bosea sp. Root381
  ref <308>: DATABASE ACCESSION NUMBER: NCBI ACCESSION: NZ_LMJT01000005.1
  ref <309>: DATABASE ENTRY DATE: 2019-04-01
  ref <313>: RELEVANT RESIDUES IN SEQ ID NO: (1)..(1503)
atacaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggataagcccttcgggggaaagatttatcgccgatagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgaaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 2033 - DNA, 1501 bp, Bosea sp. Root483D1
  ref <308>: DATABASE ACCESSION NUMBER: NCBI ACCESSION: NZ_LMJW01000010.1
  ref <309>: DATABASE ENTRY DATE: 2019-04-01
  ref <313>: RELEVANT RESIDUES IN SEQ ID NO: (1)..(1501)
tcatccaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgtgtgatgaaggccttagggttgtaaagcacttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattaagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2034 - DNA, 1501 bp, Bosea sp. Root670
  ref <308>: DATABASE ACCESSION NUMBER: NCBI ACCESSION: NZ_LMJU01000021.1
  ref <309>: DATABASE ENTRY DATE: 2019-04-01
  ref <313>: RELEVANT RESIDUES IN SEQ ID NO: (1)..(1501)
tcatccaatctgagagtttgatcctggctcagagcgaacgctggcggcaggcttaacacatgcaagtcgaacgggcacttcggtgctagtggcagacgggtgagtaacacgtgggaacgtaccttttggttcggaataatccagggaaacttggactaataccggatacgcccttcgggggaaagatttatcgccgaaagatcggcccgcgtctgattagctagttggtgaggtaaaggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggacttttaagtcggaggtgaaagcccagggctcaaccctggaattgccttcgatactgggagtcttgagttcggaagaggttggtggaactgcgagtgtagaggtgaaattcgtagatattcgcaagaacaccggtggcgaaggcggccaactggtccgatactgacgctgaggcgcgaaagcgtggggagcaaacaggattagataccctggtagtccacgccgtaaacgatgaatgccagccgttggggagcttgctcttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattaagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2035 - DNA, 1499 bp, Bosea sp. TND4EK4
  ref <308>: DATABASE ACCESSION NUMBER: NCBI ACCESSION: NZ_FTMO01000042.1
  ref <309>: DATABASE ENTRY DATE: 2019-04-01
  ref <313>: RELEVANT RESIDUES IN SEQ ID NO: (1)..(1499)
atacaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaaaggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggacttttaagtcggaggtgaaagcccagggctcaaccctggaattgccttcgatactgggagtcttgagttcggaagaggttggtggaactgcgagtgtagaggtgaaattcgtagatattcgcaagaacaccggtggcgaaggcggccaactggtccgaaactgacgctgaggcgcgaaagcgtggggagcaaacaggattagataccctggtagtccacgccgtaaacgatgaatgccagccgttggggagcttgctcttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggggcgacctggagctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2036 - DNA, 1497 bp, Bosea sp. Tri-39
  ref <308>: DATABASE ACCESSION NUMBER: NCBI ACCESSION: NZ_MZXT01000003.1
  ref <309>: DATABASE ENTRY DATE: 2019-04-01
  ref <313>: RELEVANT RESIDUES IN SEQ ID NO: (1)..(1497)
ctcatcaaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgaaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaa

SEQ ID NO: 2037 - DNA, 1497 bp, Bosea sp. Tri-44
  ref <308>: DATABASE ACCESSION NUMBER: NCBI ACCESSION: NZ_NBDP01000004.1
  ref <309>: DATABASE ENTRY DATE: 2019-04-01
  ref <313>: RELEVANT RESIDUES IN SEQ ID NO: (1)..(1497)
ctcatcaaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaa

SEQ ID NO: 2038 - DNA, 1497 bp, Bosea sp. Tri-49; identical to SEQ ID NO: 2036
  ref <308>: DATABASE ACCESSION NUMBER: NCBI ACCESSION: NZ_CP017946.1
  ref <309>: DATABASE ENTRY DATE: 2019-04-01
  ref <313>: RELEVANT RESIDUES IN SEQ ID NO: (1)..(1497)

SEQ ID NO: 2039 - DNA, 1497 bp, Bosea sp. Tri-54; identical to SEQ ID NO: 2036
  ref <308>: DATABASE ACCESSION NUMBER: NCBI ACCESSION: NZ_MZXU01000015.1
  ref <309>: DATABASE ENTRY DATE: 2019-04-01
  ref <313>: RELEVANT RESIDUES IN SEQ ID NO: (1)..(1497)

SEQ ID NO: 2040 - DNA, 1501 bp, Bosea sp. UNC402CLCol
  ref <308>: DATABASE ACCESSION NUMBER: NCBI ACCESSION: NZ_JQJJ01000007.1
  ref <309>: DATABASE ENTRY DATE: 2019-04-01
  ref <313>: RELEVANT RESIDUES IN SEQ ID NO: (1)..(1501)
tcatccaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgggagtcttgagttcggaagaggttggtggaactgcgagtgtagaggtgaaattcgtagatattcgcaagaacaccagtggcgaaggcggccaactggtccgaaactgacgctgaggcgcgaaagcgtggggagcaaacaggattagataccctggtagtccacgccgtaaacgatgaatgccagccgttggggagcttgctcttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2041 - DNA, 1502 bp, Bosea sp. WAO
  ref <308>: DATABASE ACCESSION NUMBER: NCBI ACCESSION: NZ_JXTJ01000024.1
  ref <309>: DATABASE ENTRY DATE: 2019-04-01
  ref <313>: RELEVANT RESIDUES IN SEQ ID NO: (1)..(1502)
ctcatcaaatctgagagtttgatcctggctcagagcgaacgctggcggcaggcttaacacatgcaagtcgaacgggcacttcggtgctagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccggtggcgaaggcggccaactggtccgatactgacgctgaggcgcgaaagcgtggggagcaaacaggattagataccctggtagtccacgccgtaaacgatgaatgccagccgttggggtgcatgcacttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcgacagagatgtctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggtgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2042 - DNA, 1501 bp, Bosea thiooxidans
  ref <308>: DATABASE ACCESSION NUMBER: NCBI ACCESSION: NZ_FUYX01000002.1
  ref <309>: DATABASE ENTRY DATE: 2019-04-01
  ref <313>: RELEVANT RESIDUES IN SEQ ID NO: (1)..(1501)
tcatccaatctgagagtttgatcctggctcagagcgaacgctggcggcaggcttaacacatgcaagtcgaacgggcacttcggtgctagtggcagacgggtgagtaacacgtgggaacgtacctttcggttcggaataactcagggaaacttgaactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgggagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggagcatgctcttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgatcggcagagatgcctttcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaagggcgacctcgagctaatcccaaaaagccgtctcagttcagattgtactctgcaactcgagtacatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtag

SEQ ID NO: 2043 - DNA, 1502 bp, Bosea vaviloviae
  ref <308>: DATABASE ACCESSION NUMBER: NCBI ACCESSION: NZ_CP017147.1
  ref <309>: DATABASE ENTRY DATE: 2019-04-01
  ref <313>: RELEVANT RESIDUES IN SEQ ID NO: (1)..(1502)
caatctgagagtttgatcctggctcagagcgaacgctggcggcaggcttaacacatgcaagtcgaacgggtatcttcggatactagtggcagacgggtgagtaacacgtgggaacgtacctttcggttcggaataattcagggaaacttggactaataccggatacgcccttcgggggaaagatttatcgccgatagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgctcggaatcactgggcgtaaagggcgcgtaggcggactcttaagtcgggggtgaaagcccagggctcaaccctggaattgccttcgatactgagagtcttgagttcggaagaggttggtggaactgcgagtgtagaggtgaaattcgtagatattcgcaagaacaccagtggcgaaggcggccaactggtccgatactgacgctgaggcgcgaaagcgtggggagcaaacaggattagataccctggtagtccacgccgtaaacgatgaatgccagccgttggggtgcatgcacctcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagcttttgacatgtccggtttgaggaacagagatgtacctcttcagttcggctggccggaacacaggtgctgcatggctgtcgtcagctcgtgtcgtgagatgttgggttaagtcccgcaacgagcgcaaccctcgcccctagttgccatcattcagttgggaactctagggggactgccggtgataagccgcgaggaaggtggggatgacgtcaagtcctcatggcccttacaggctgggctacacacgtgctacaatggcggtgacaatgggcagcgaaggagcgatccggtgctaatcccaaaaagccgtctcagttcagattgcactctgcaactcgagtgcatgaaggtggaatcgctagtaatcgtggatcagcatgccacggtgaatacgttcccgggccttgtacacaccgcccgtcacaccatgggagttgggtttacccgaaggcgtcgcgctaaccgcaaggaggcaggcgaccacggtaggctcagcgactggggtgaagtcgtaacaaggtagccgtaggggaacctgcggctggatcacctcctttctaaggtcggatc

SEQ ID NO: 2044 - DNA, 1456 bp, Brachybacterium endophyticum
  ref <308>: DATABASE ACCESSION NUMBER: NCBI ACCESSION: NZ_QFKX01000011.1
  ref <309>: DATABASE ENTRY DATE: 2019-04-01
  ref <313>: RELEVANT RESIDUES IN SEQ ID NO: (1)..(1456)
atggccgtgcttgcacggtcggattagtggcgaacgggtgagtaacacgtgagtaacctgccccccacttcgggataacctcgggaaatcggggctaataccggatacgagtttccaccgcatggtggtttctggaaagtttttcggtgggggatgggctcgcgtcctatcagcttgttggtgaggtagtggcttaccaaggcgatgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatggggagcgaacaggattagataccctggtagtccatgccgtaaacgttgggcactaggtgtggggcacattccacgtggtccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccggacgactgcagagatgtggttttctttggactggtgcacaggtggtgcatggttgtcgtcagctcgtgtcgtgagatgttgggttaagtcccgcaacgagcgcaaccctcgttccatgttgccagcacttcgggtggggactcatgggagactgccggggtcaactcggaggaaggtggggacgacgtcaaatcatcatgccccttatgtcttgggcttcacgcatgctacaatggccggtacaatgggttgcaatactgtgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccatcccttgtggggggagccgtcgaaggtgggatcggtgattgggactaagtcgtaacaaggtagccgtaccggaaggtgcggctggatcacctcctttctaagga

SEQ ID NO: 2045 - DNA, 1527 bp, Brachybacterium paraconglomeratum
  ref <308>: DATABASE ACCESSION NUMBER: NCBI ACCESSION: NZ_ML133873.1
  ref <309>: DATABASE ENTRY DATE: 2019-04-01
  ref <313>: RELEVANT RESIDUES IN SEQ ID NO: (1)..(1527)
ttcatggagagtttgatcctggctcaggacgaacgctggcggcgtgcttaacacatgcaagtcgaacgatgacggtggtgcttgcaccgcctgattagtggcgaacgggtgagtaacacgtgagtaacctgccctccacttcgggataacctcgggaaatcgtggctaataccggatatgagcactcatcgcatggtgggtgttggaaagatttatcggtgggggatggactcgcggcctatcagtttgttggtgaggtgatggctcaccaagacgatgacgggtagccggcctgagagggcgaccggccacactgggactgagacacggcccagactcctacgggaggcagcagtggggaatattgcacaatgggcgaaagcctgatgcagcgacgccgcgtgggggatgacggccttcgggttgtaaacccctttcagtagggaagaagcgagagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatgcactggacggctgcagagatgtggctttctttggactggtgcacaggtggtgcatggttgtcgtcagctcgtgtcgtgagatgttgggttaagtcccgcaacgagcgcaaccctcgttctatgttgccagcacgtaatggtggggactcataggagactgccggggtcaactcggaggaaggtggggacgacgtcaaatcatcatgccccttatgtcttgggcttcaagcatgctacaatggtcggtacaatgggttgcgaaactgtgaggtggagcgaatcccaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtctaaggtgggatcggtgattgggactaagtcgtaacaaggtagccgtaccggaaggtgcggctggatcacctcctttctaagga

SEQ ID NO: 2046 - DNA, 325 bp, Brachybacterium saurashtrense
  ref <308>: DATABASE ACCESSION NUMBER: NCBI ACCESSION: NZ_ML133889.1
  ref <309>: DATABASE ENTRY DATE: 2019-04-01
  ref <313>: RELEVANT RESIDUES IN SEQ ID NO: (1)..(325)
tttcatggagagtttgatcctggctcaggacgaacgctggcggcgtgcttaacacatgcaagtcgaacgatgacggtggtgcttgcaccgcctgattagtggcgaacgggtgagtaacacgtgagtaacctgccccccacttcgggataacctcgggaaatcgtggctaataccggatacgaacactcatcgcatggtgggtgttggaaagatttattggtgggggatggactcgcggcctatcagtttgttggtgaggtaatggctcaccaaggcgatgacgggtagccggcctgagagggcgaccggccacactgggactgag

SEQ ID NO: 2047 - DNA, 1527 bp, Brachybacterium sp. EE-P12
  ref <308>: DATABASE ACCESSION NUMBER: NCBI ACCESSION: NZ_QXCP01000016.1
  ref <309>: DATABASE ENTRY DATE: 2019-04-01
  ref <313>: RELEVANT RESIDUES IN SEQ ID NO: (1)..(1527)
ttcatggagagtttgatcctggctcaggacgaacgctggcggcgtgcttaacacatgcaagtcgaacgatgacggccgtgcttgcacggtctgattagtggcgaacgggtgagtaacacgtgagtaacctgcccccctcttcgggataacctcgggaaatcgtggctaataccggatacgagcgctcatcgcatggtgggtgttggaaagatttatcggtgggggatggactcgcggcctatcagtttgttggtgaggtgatggctcaccaagacgatgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgctgattaattcgatgcaacgcgaagaaccttaccaaggcttgacatgcactggacggctgcagagatgtggctttctttggactggtgcacaggtggtgcatggttgtcgtcagctcgtgtcgtgagatgttgggttaagtcccgcaacgagcgcaaccctcgttctatgttgccagcacgtgatggtggggactcataggagactgccggggtcaactcggaggaaggtggggacgacgtcaaatcatcatgccccttatgtcttgggcttcaagcatgctacaatggtcggtacaatgggttgcgaagctgtgaggtggagcgaatcccaaaaagccggcctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccatcctcgtgagggagctgtcgaaggtgggatcggtgattgggactaagtcgtaacaaggtagccgtaccggaaggtgcggctggatcacctcctttctaagga

SEQ ID NO: 2048 - DNA, 1513 bp, Brachyspira pilosicoli
  ref <308>: DATABASE ACCESSION NUMBER: NCBI ACCESSION: NZ_UFTP01000001.1
  ref <309>: DATABASE ENTRY DATE: 2019-04-01
  ref <313>: RELEVANT RESIDUES IN SEQ ID NO: (1)..(1513)
agtatggagagtttgattctggctcagagcgaacgttggcgatgcgtcttaagcatgcaagtcgagcgggcttattcgggcaactggataagttagcggcgaactggtgagtaacacgtaggtaatctgccgtgaagtgggggataacccatggaaacatggactaataccgcatatactcttgctacataagtagagtagaggaaagttttttcgcttcacgatgagcctgcggcctattagcctgttggtagggtaatggcctaccaaagctacgataggtagccgacctgagagggtgaccggccacattgggactgagatacggcccagactcctacgggaggcagcagctgagaatcttccacaatggacgaaagtctgatggagcgacatcgcgtgagggatgaaggccttcgggttgtaaacctcggaaattatcgaagaatgagtgacagtagataatgtaagcctcggctaactacgtgccagcagccgcggtaatacgtaggaggcaaacgttgctcggatttactgggcgtaaagggtgagtaggcggatttataagtctaaggtgaaagaccgaagctcaacttcgggaacgcctcggatactgtaagtcttggatattgtaggggatgatggaattctcggtgtagcggtggaatgcgcagatatcgagaggaacacctatagcgaaggcagtcatctgggcatttatcgacgctgaatcacgaaagctaggggagcaaacaggcttagataccctggtagtcctagccgtaaacgttgtacactaggtgcttctatttaaataggagtgccgtagctaacgtcttaagtgtaccgcctgaggagtatgcccgcaagggtgaaactcaaagaaattgacgggtccccgcacaagtggtggagcatgtggtttaattcgatgatacgcgaaaaaccttacctgggtttgaattgttagatgaatgatttagagataagtcagaccgcaaggacgtttaacataggtgctgcatggctgtcgtcagctcgtgtcgtgagatgttgggttaagtcccgcaacgagcgcaaccctcaccctctgttgctaccgagtaatgtcgagcactcttaggggactgcctacgttcaagtaggaggaaggtggggatgatgtcaagtcctcatggcccttatgtccagggctacacacgtgctacaatggcaagtacaaagagaagcaagaccgcgaggtggagcaaaactcaaaaaagttgcctcagttcggattggagtctgaaactcgactccatgaagttggaatcactagtaatcgtagatcagaacgctacggtgaatacgttcccggggattgtacacaccgcccgtcacgccatcggagttggttttacctgaagccgttagcctaaccgcaaggagggcggcgtcgaaggtgggactgatgatgagggtgaagtcgtaacaaggcagccgtaccggaaggtgtggctggatcacctccttt

SEQ ID NO: 2049 - DNA, 1538 bp, Bradymonadaceae bacterium TMQ3
  ref <308>: DATABASE ACCESSION NUMBER: NCBI ACCESSION: NZ_QRGZ01000017.1
  ref <309>: DATABASE ENTRY DATE: 2019-04-01
  ref <313>: RELEVANT RESIDUES IN SEQ ID NO: (1)..(1538)
aaactggagagtttgatcctggctcagaatgaacgctggcggcgtgcctaacacatgcaagtcgagcgagaaagggacttcggtcctgagtagagcggcgaacgggtgagtaacacgtgagtaacgtaccttcagatgggggataaccactcgaaagggtggctaataccgcataagaccacagcgcctttgggtgcagaggtcaaagccttcgggtgtctgaagatcggctcgcggcccattaggtagttggtggggtaatggcctaccaagcctcagatgggtagctggtctgagaggacgatcagccacactgggactgagacacggcccagactcctacgggaggcagcagtggggaatcttgcgcaatgggcgaaagcctgacgcagcaacgccgcgtgtgtgaagaaggctttcgggtcgtaaagcactgtcgggagggaagagtgcccgggcttgtcccgggagagacggtacctcccaaggaagcaccggctaactccgtgccagcagccgcggtaatacggagggtgcaagcgttattcggaatcattgggcgtaaagcgcgcgcaggcggccatgcaagtctgacgtgaaatcccggggctcaacctcggaactgcgttggaaactgtatggcttgagtttgggagaggttcgtggaattccaggtgtaggggtgaaatccgtagagatctggaggaacaccagtggcgaaggcgacgaactggaccaatactgacgctgaggcgcgaaagcgtggggagcaaacaggattagataccctggtagtccacgccgtaaacgatgttcactagttgccggcctaattgagggtcggtgacgcagctaacgcattaagtgaaccgcctggggagtacggccgcaaggttaaaactcaaaggaattgacgggggcccgcacaagcggtggagcatgtggtttaattcgaagcaacgcgaagaaccttacctgggtttgacatcccgcgaagagagggtaatgcctcttgtgcccttcggggagcgcggtgacaggtgctgcatggctgtcgtcagctcgtgtcgtgagatgttcggttaagtccggtaacgagcgcaacccttgtccttagttgctaccagttcggctgggcactctaaggagactgccgatgtgaaatcggaggaaggtggggatgacgtcaagtcctcatggcccttatgcccagggctacacacgtgctacaatggctggtacaaagagctgcgaaactgcgaagttaagctaatctcaaaaagccagcctcagttcggattgtagtctgcaactcgactgcatgaaggcggaatcgctagtaatcgcggatcagcatgccgcggtgaatacgttcccgggccttgtacacaccgcccgtcacaccatgggagtcgtttgctccagaagtcggtgacccaacccttgtggagggagccgccgaaggagtgaatggtgactggggtgaagtcgtaacaaggtagccgtaggggaacctgcggctggatcacctcctttta

SEQ ID NO: 2050 - DNA, 1538 bp, Bradymonadales bacterium SEH01
  ref <308>: DATABASE ACCESSION NUMBER: NCBI ACCESSION: NZ_SADD01000029.1
  ref <309>: DATABASE ENTRY DATE: 2019-04-01
  ref <313>: RELEVANT RESIDUES IN SEQ ID NO: (1)..(1538)
aaactggagagtttgatcctggctcagaatgaacgctggcggcgtgcctaacacatgcaagtcgagcgagaaagggacttcggtcctgagtagagcggcgaacgggtgagtaacacgtgagtaacgtaccttcagatgggggataaccactcgaaagggtggctaataccgcataagaccacagcgcctttgggtgcagaggtcaaagccttcgggtgtctgaagatcggctcgcggcccattaggtagttggtggggtaatggcctaccaagcctcagatgggtagctggtctgagaggacgatcagccacactgggactgagacacggcccagactcctacgggaggcagcagtggggaatcttgcgcaatgggcgaaagcctgacgcagcaacgccgcgtgtgtgaagaaggctttcgggtcgtaaagcactgtcgggagggaagagtgcccgggcttgtcccgggagagacggtacctcccaaggaagcaccggctaactccgtgccagcagccgcggtaatacggagggtgcaagcgttattcggaatcattgggcgtaaagcgcgcgcaggcggccatgcaagtctgacgtgaaatcccggggctcaacctcggaactgcgttggaaactgtatggcttgagtttgggagaggttcgtggaattccaggtgtaggggtgaaatccgtagagatctggaggaacaccagtggcgaaggcgacgaactggaccaatactgacgctgaggcgcgaaagcgtggggagcaaacaggattagataccctggtagtccacgccgtaaacgatgttcactagttgccggcctaattgagggtcggtgacgcagctaacgcattaagtgaaccgcctggggagtacggccgcaaggttaaaactcaaaggaattgacgggggcccgcacaagcggtggagcatgtggtttaattcgaagcaacgcgaagaaccttacctgggtttgacatcccgcgaagagagggtaatgcctcttgtgcccttcggggagcgcggtgacaggtgctgcatggctgtcgtcagctcgtgtcgtgagatgttcggttaagtccggtaacgagcgcaacccttgtccttagttgctaccagttcggctgggcactctaaggagactgccgatgtgaaatcggaggaaggtggggatgacgtcaagtcctcatggcccttatgcccagggctacacacgtgctacaatggctggtacaaagagctgcgagactgcgaagttaagctaatctcaaaaagccagcctcagttcggattgtagtctgcaactcgactgcatgaaggcggaatcgctagtaatcgcggatcagcatgccgcggtgaatacgttcccgggccttgtacacaccgcccgtcacaccatgggagtcgtttgctccagaagtcggtgacccaacccttgtggagggagccgccgaaggagtgaatggtgactggggtgaagtcgtaacaaggtagccgtaggggaacctgcggctggatcacctcctttta

SEQ ID NO: 2051 - DNA, 1497 bp, Bradyrhizobiaceae bacterium SG-6C; identical to SEQ ID NO: 1162
  ref <308>: DATABASE ACCESSION NUMBER: NCBI ACCESSION: NZ_CM001195.1
  ref <309>: DATABASE ENTRY DATE: 2019-04-01
  ref <313>: RELEVANT RESIDUES IN SEQ ID NO: (1)..(1497)

SEQ ID NO: 2052 - DNA, 1495 bp, Bradyrhizobium algeriense
  ref <308>: DATABASE ACCESSION NUMBER: NCBI ACCESSION: NZ_PYCN01000001.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagatggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttct

SEQ ID NO: 2053 - DNA, 1495 bp, Bradyrhizobium betae
  ref <308>: DATABASE ACCESSION NUMBER: NCBI ACCESSION: NZ_MZXW01000016.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacatacctcttggttcggaacaacacagggaaacttgtgctaataccggataagcccttacggggaaagatttatcgccgagagattggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccagcaatggaggcagccggccacggtagggtcagcgactggggtgaagtcgtaacaaggtagccgtaggggaacctgcggctggatcacctcctttctaa

SEQ ID NO: 2054 - DNA, 1493 bp, Bradyrhizobium diazoefficiens
  ref <308>: DATABASE ACCESSION NUMBER: NCBI ACCESSION: NZ_CP029603.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtagccgtaggggaacctgcggctggatcacctcctttct

SEQ ID NO: 2055 - DNA, 1495 bp, Bradyrhizobium elkanii
  ref <308>: DATABASE ACCESSION NUMBER: NCBI ACCESSION: NZ_SEMA01000013.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaa

SEQ ID NO: 2056 - DNA, 1497 bp, Bradyrhizobium embrapense
  ref <308>: DATABASE ACCESSION NUMBER: NCBI ACCESSION: NZ_LFIP02000005.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2057 - DNA, 1497 bp, Bradyrhizobium erythrophlei
  ref <308>: DATABASE ACCESSION NUMBER: NCBI ACCESSION: NZ_LT670849.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2058 - DNA, 1495 bp, Bradyrhizobium genosp. SA-3
  ref <308>: DATABASE ACCESSION NUMBER: NCBI ACCESSION: NZ_PSRT01000097.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtagccgtaggggaacctgcggctggatcacctcctttctaa

SEQ ID NO: 2059 - DNA, 1497 bp, Bradyrhizobium genosp. SA-4
  ref <308>: DATABASE ACCESSION NUMBER: NCBI ACCESSION: NZ_KI421499.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagacgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcgaaggggcaacccctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2060 - DNA, 1493 bp, Bradyrhizobium guangdongense
  ref <308>: DATABASE ACCESSION NUMBER: NCBI ACCESSION: NZ_CP030051.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgcaaggaggcagccggccacggtagggtcagcgactggggtgaagtcgtaacaaggtagccgtaggggaacctgcggctggatcacctcctttctaa

SEQ ID NO: 2061 - DNA, 1495 bp, Bradyrhizobium guangxiense
  ref <308>: DATABASE ACCESSION NUMBER: NCBI ACCESSION: NZ_CP022219.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaa

SEQ ID NO: 2062 - DNA, 1497 bp, Bradyrhizobium icense
  ref <308>: DATABASE ACCESSION NUMBER: NCBI ACCESSION: NZ_CP016428.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacccagggaaacttgggctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2063 - DNA, 1499 bp, Bradyrhizobium lablabi
  ref <308>: DATABASE ACCESSION NUMBER: NCBI ACCESSION: NZ_LT670845.1
  ref <309>: DATABASE ENTRY DATE: 2019-04-01
  ref <313>: RELEVANT RESIDUES IN SEQ ID NO: (1)..(1499)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagatggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2064 - DNA, 1497 bp, Bradyrhizobium liaoningense
  ref <308>: DATABASE ACCESSION NUMBER: NCBI ACCESSION: NZ_LUKO01000172.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2065 - DNA, 1495 bp, Bradyrhizobium manausense
  ref <308>: DATABASE ACCESSION NUMBER: NCBI ACCESSION: NZ_LJYG01000047.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcgaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgcaaggaggcagccggccacggtagggtcagcgactggggtgaagtcgtaacaaggtagccgtaggggaacctgcggctggatcacctcctttctaagg

SEQ ID NO: 2066 - DNA, 1499 bp, Bradyrhizobium neotropicale
  ref <308>: DATABASE ACCESSION NUMBER: NCBI ACCESSION: NZ_LSEF01000002.1
  ref <309>: DATABASE ENTRY DATE: 2019-04-01
  ref <313>: RELEVANT RESIDUES IN SEQ ID NO: (1)..(1499)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 2067 - DNA, 1497 bp, Bradyrhizobium oligotrophicum
  ref <308>: DATABASE ACCESSION NUMBER: NCBI ACCESSION: NC_020453.1
  ref <309>: DATABASE ENTRY DATE: 2019-04-01
  ref <313>: RELEVANT RESIDUES IN SEQ ID NO: (1)..(1497)
ttcaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtggggtaatggcccaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggtgggtttactcaccagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtttgggaccggtcgcagagatgtgaccttctcttcggagcccgaaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacagtgggaagctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 2068 - DNA, 1497 bp, Bradyrhizobium paxllaeri; identical to SEQ ID NO: 2062
  ref <308>: DATABASE ACCESSION NUMBER: NCBI ACCESSION: NZ_MAXB01000044.1
  ref <309>: DATABASE ENTRY DATE: 2019-04-01
  ref <313>: RELEVANT RESIDUES IN SEQ ID NO: (1)..(1497)

SEQ ID NO: 2069 - DNA, 1497 bp, Bradyrhizobium retamae
  ref <308>: DATABASE ACCESSION NUMBER: NCBI ACCESSION: NZ_LLYA01000002.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacccagggaaacttgggctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcgggccccagagatggggtccttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggtgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2070 - DNA, 1497 bp, Bradyrhizobium sp.
  ref <308>: DATABASE ACCESSION NUMBER: NCBI ACCESSION: NZ_LN907826.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2071 - DNA, 1493 bp, Bradyrhizobium sp. 2 39S1MB
  ref <308>: DATABASE ACCESSION NUMBER: NCBI ACCESSION: NZ_CP029426.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaaggtagtgcgctaacccgcaagggaggcagctaaccacggtagggtcagcgactggggtgaagtcgtaacaaggtagccgtaggggaacctgcggctggatcacctcctttct

SEQ ID NO: 2072 - DNA, 1493 bp, Bradyrhizobium sp. 3 85S1MB
  ref <308>: DATABASE ACCESSION NUMBER: NCBI ACCESSION: NZ_CP029427.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttct

SEQ ID NO: 2073 - DNA, 1493 bp, Bradyrhizobium sp. AC87j1
  ref <308>: DATABASE ACCESSION NUMBER: NCBI ACCESSION: NZ_PTFE01000021.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttct

SEQ ID NO: 2074 - DNA, 1497 bp, Bradyrhizobium sp. ARR65
  ref <308>: DATABASE ACCESSION NUMBER: NCBI ACCESSION: NZ_AWZU01000001.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacccagggaaacttgggctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacagtgggatgcgaaggcgcaagccctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccgcaaggaggcagccggccacggtagggtcagcgactggggtgaagtcgtaacaaggtagccgtaggggaacctgcggctggatcacctcctttctaagg

SEQ ID NO: 2075 - DNA, 1081 bp, Bradyrhizobium sp. AS23.2
  ref <308>: DATABASE ACCESSION NUMBER: NCBI ACCESSION: NZ_LGHM01000394.1
  ref <309>: DATABASE ENTRY DATE: 2019-04-01
  ref <313>: RELEVANT RESIDUES IN SEQ ID NO: (1)..(1081)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctacca

SEQ ID NO: 2076 - DNA, 1497 bp, Bradyrhizobium sp. AT1
  ref <308>: DATABASE ACCESSION NUMBER: NCBI ACCESSION: NZ_JXDL01000001.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2077 - DNA, 1497 bp, Bradyrhizobium sp. Ai1a-2
  ref <308>: DATABASE ACCESSION NUMBER: NCBI ACCESSION: NZ_AUEZ01000020.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2078 - DNA, 1499 bp, Bradyrhizobium sp. BR 10245
  ref <308>: DATABASE ACCESSION NUMBER: NCBI ACCESSION: NZ_LUUB01000076.1
  ref <309>: DATABASE ENTRY DATE: 2019-04-01
  ref <313>: RELEVANT RESIDUES IN SEQ ID NO: (1)..(1499)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcgaagacgcaagtcctggcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 2079 - DNA, 1497 bp, Bradyrhizobium sp. BR 10303
  ref <308>: DATABASE ACCESSION NUMBER: NCBI ACCESSION: NZ_LNCU01000022.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2080 - DNA, 1497 bp, Bradyrhizobium sp. BTAi1
  ref <308>: DATABASE ACCESSION NUMBER: NCBI ACCESSION: NC_009485.1
  ref <309>: DATABASE ENTRY DATE: 2019-04-01
  ref <313>: RELEVANT RESIDUES IN SEQ ID NO: (1)..(1497)
ttcaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttggtgggtttactcaccagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtttgggaccggtcgcagagacgtgaccttctcttcggagcccgaaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacagtgggaagctaaggggtgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 2081 - DNA, 1497 bp, Bradyrhizobium sp. CCBAU 15544
  ref <308>: DATABASE ACCESSION NUMBER: NCBI ACCESSION: NZ_AJQF01000204.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2082 - DNA, 1497 bp, Bradyrhizobium sp. CCBAU 15635; identical to SEQ ID NO: 2081
  ref <308>: DATABASE ACCESSION NUMBER: NCBI ACCESSION: NZ_AJQH01000168.1
  ref <309>: DATABASE ENTRY DATE: 2019-04-01
  ref <313>: RELEVANT RESIDUES IN SEQ ID NO: (1)..(1497)

SEQ ID NO: 2083 - DNA, 1493 bp, Bradyrhizobium sp. CCBAU 51670; identical to SEQ ID NO: 2060
  ref <308>: DATABASE ACCESSION NUMBER: NCBI ACCESSION: NZ_CP030053.1
  ref <309>: DATABASE ENTRY DATE: 2019-04-01
  ref <313>: RELEVANT RESIDUES IN SEQ ID NO: (1)..(1493)

SEQ ID NO: 2084 - DNA, 1495 bp, Bradyrhizobium sp. CCBAU 51757; identical to SEQ ID NO: 2061
  ref <308>: DATABASE ACCESSION NUMBER: NCBI ACCESSION: NZ_LBJQ01000085.1
  ref <309>: DATABASE ENTRY DATE: 2019-04-01
  ref <313>: RELEVANT RESIDUES IN SEQ ID NO: (1)..(1495)

SEQ ID NO: 2085 - DNA, 1495 bp, Bradyrhizobium sp. CCBAU 51770
  ref <308>: DATABASE ACCESSION NUMBER: NCBI ACCESSION: NZ_RKMK01000040.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagacgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaacccgcaagggaggcagccggccacggtagggtcagcgactggggtgaagtcgtaacaaggtagccgtaggggaacctgcggctggatcacctcctttctaa

SEQ ID NO: 2086 - DNA, 1495 bp, Bradyrhizobium sp. CCBAU 51778; identical to SEQ ID NO: 2085
  ref <308>: DATABASE ACCESSION NUMBER: NCBI ACCESSION: NZ_CP022221.1
  ref <309>: DATABASE ENTRY DATE: 2019-04-01
  ref <313>: RELEVANT RESIDUES IN SEQ ID NO: (1)..(1495)

SEQ ID NO: 2087 - DNA, 1495 bp, Bradyrhizobium sp. CCBAU 51781; identical to SEQ ID NO: 2085
  ref <308>: DATABASE ACCESSION NUMBER: NCBI ACCESSION: NZ_RDRA01000037.1
  ref <309>: DATABASE ENTRY DATE: 2019-04-01
  ref <313>: RELEVANT RESIDUES IN SEQ ID NO: (1)..(1495)

SEQ ID NO: 2088 - DNA, 1495 bp, Bradyrhizobium sp. CCBAU 51787; identical to SEQ ID NO: 2085
  ref <308>: DATABASE ACCESSION NUMBER: NCBI ACCESSION: NZ_LBJM01000030.1
  ref <309>: DATABASE ENTRY DATE: 2019-04-01
  ref <313>: RELEVANT RESIDUES IN SEQ ID NO: (1)..(1495)

SEQ ID NO: 2089 - DNA, 1495 bp, Bradyrhizobium sp. CCBAU 53390; identical to SEQ ID NO: 2061
  ref <308>: DATABASE ACCESSION NUMBER: NCBI ACCESSION: NZ_LBJC01000082.1
  ref <309>: DATABASE ENTRY DATE: 2019-04-01
  ref <313>: RELEVANT RESIDUES IN SEQ ID NO: (1)..(1495)

SEQ ID NO: 2090 - DNA, 1493 bp, Bradyrhizobium sp. CCBAU 53424; identical to SEQ ID NO: 2060
  ref <308>: DATABASE ACCESSION NUMBER: NCBI ACCESSION: NZ_RDQY01000001.1
  ref <309>: DATABASE ENTRY DATE: 2019-04-01
  ref <313>: RELEVANT RESIDUES IN SEQ ID NO: (1)..(1493)

SEQ ID NO: 2091 - DNA, 1493 bp, Bradyrhizobium sp. CCBAU 53426; identical to SEQ ID NO: 2060
  ref <308>: DATABASE ACCESSION NUMBER: NCBI ACCESSION: NZ_RDQZ01000001.1
  ref <309>: DATABASE ENTRY DATE: 2019-04-01
  ref <313>: RELEVANT RESIDUES IN SEQ ID NO: (1)..(1493)

SEQ ID NO: 2092 - DNA, 1497 bp, Bradyrhizobium sp. CCGE-LA001
  ref <308>: DATABASE ACCESSION NUMBER: NCBI ACCESSION: NZ_CP013949.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 2093 - DNA, 1497 bp, Bradyrhizobium sp. CCH10-C7; identical to SEQ ID NO: 1160
  ref <308>: DATABASE ACCESSION NUMBER: NCBI ACCESSION: NZ_LSIN01000075.1
  ref <309>: DATABASE ENTRY DATE: 2019-04-01
  ref <313>: RELEVANT RESIDUES IN SEQ ID NO: (1)..(1497)

SEQ ID NO: 2094 - DNA, 1497 bp, Bradyrhizobium sp. CCH4-A6; identical to SEQ ID NO: 1160
  ref <308>: DATABASE ACCESSION NUMBER: NCBI ACCESSION: NZ_LSIM01000122.1
  ref <309>: DATABASE ENTRY DATE: 2019-04-01
  ref <313>: RELEVANT RESIDUES IN SEQ ID NO: (1)..(1497)

SEQ ID NO: 2095 - DNA, 1497 bp, Bradyrhizobium sp. CCH5-F6
  ref <308>: DATABASE ACCESSION NUMBER: NCBI ACCESSION: NZ_LSIC01000086.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2096 - DNA, 1499 bp, Bradyrhizobium sp. Cp5.3; identical to SEQ ID NO: 2066
  ref <308>: DATABASE ACCESSION NUMBER: NCBI ACCESSION: NZ_AUFA01000009.1
  ref <309>: DATABASE ENTRY DATE: 2019-04-01
  ref <313>: RELEVANT RESIDUES IN SEQ ID NO: (1)..(1499)

SEQ ID NO: 2097 - DNA, 1497 bp, Bradyrhizobium sp. DOA1; identical to SEQ ID NO: 2092
  ref <308>: DATABASE ACCESSION NUMBER: NCBI ACCESSION: NZ_JXJM01000001.1
  ref <309>: DATABASE ENTRY DATE: 2019-04-01
  ref <313>: RELEVANT RESIDUES IN SEQ ID NO: (1)..(1497)

SEQ ID NO: 2098 - DNA, 1497 bp, Bradyrhizobium sp. DOA9
  ref <308>: DATABASE ACCESSION NUMBER: NCBI ACCESSION: NZ_DF820425.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2099 - DNA, 1497 bp, Bradyrhizobium sp. Ec3.3
  ref <308>: DATABASE ACCESSION NUMBER: NCBI ACCESSION: NZ_AXAS01000008.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggtgtagcaatacatcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagacgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 2100 - DNA, 1493 bp, Bradyrhizobium sp. INPA54B
  ref <308>: DATABASE ACCESSION NUMBER: NCBI ACCESSION: NZ_PGVG01000009.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttct

SEQ ID NO: 2101 - DNA, 1497 bp, Bradyrhizobium sp. LMTR 3; identical to SEQ ID NO: 2062
  ref <308>: DATABASE ACCESSION NUMBER: NCBI ACCESSION: NZ_MAXC01000003.1
  ref <309>: DATABASE ENTRY DATE: 2019-04-01
  ref <313>: RELEVANT RESIDUES IN SEQ ID NO: (1)..(1497)

SEQ ID NO: 2102 - DNA, 1497 bp, Bradyrhizobium sp. LTSP849
  ref <308>: DATABASE ACCESSION NUMBER: NCBI ACCESSION: NZ_JYMR01000018.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgcagcaatgcgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaaggtagtgcgctaacccgcaagggaggcagctaaccacggtagggtcagcgactggggtgaagtcgtaacaaggtagccgtaggggaacctgcggctggatcacctcctttctaagg

SEQ ID NO: 2103 - DNA, 1497 bp, Bradyrhizobium sp. LTSP857; identical to SEQ ID NO: 2102
  ref <308>: DATABASE ACCESSION NUMBER: NCBI ACCESSION: NZ_JYMS01000032.1
  ref <309>: DATABASE ENTRY DATE: 2019-04-01
  ref <313>: RELEVANT RESIDUES IN SEQ ID NO: (1)..(1497)

SEQ ID NO: 2104 - DNA, 1499 bp, Bradyrhizobium sp. LTSP885
  ref <308>: DATABASE ACCESSION NUMBER: NCBI ACCESSION: NZ_JYMT01000017.1
  ref <309>: DATABASE ENTRY DATE: 2019-04-01
  ref <313>: RELEVANT RESIDUES IN SEQ ID NO: (1)..(1499)
tccaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcagaggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2105 - DNA, 1499 bp, Bradyrhizobium sp. LTSPM299; identical to SEQ ID NO: 2104
  ref <308>: DATABASE ACCESSION NUMBER: NCBI ACCESSION: NZ_JYMU01000004.1
  ref <309>: DATABASE ENTRY DATE: 2019-04-01
  ref <313>: RELEVANT RESIDUES IN SEQ ID NO: (1)..(1499)

SEQ ID NO: 2106 - DNA, 1495 bp, Bradyrhizobium sp. LVM 105
  ref <308>: DATABASE ACCESSION NUMBER: NCBI ACCESSION: NZ_QZMV01000009.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaa

SEQ ID NO: 2107 - DNA, 1497 bp, Bradyrhizobium sp. Leaf396
  ref <308>: DATABASE ACCESSION NUMBER: NCBI ACCESSION: NZ_LMQJ01000023.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2108 - DNA, 1495 bp, Bradyrhizobium sp. Leo121
  ref <308>: DATABASE ACCESSION NUMBER: NCBI ACCESSION: NZ_PSRS01000082.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaa

SEQ ID NO: 2109 - DNA, 1493 bp, Bradyrhizobium sp. MOS002
  ref <308>: DATABASE ACCESSION NUMBER: NCBI ACCESSION: NZ_PYFX01000001.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccagcaatggaggcagccggccacggtagggtcagcgactggggtgaagtcgtaacaaggtagccgtaggggaacctgcggctggatcacctcctttct

SEQ ID NO: 2110 - DNA, 1556 bp, Bradyrhizobium sp. MOS003; identical to SEQ ID NO: 234
  ref <308>: DATABASE ACCESSION NUMBER: NCBI ACCESSION: NZ_PYFW01000021.1
  ref <309>: DATABASE ENTRY DATE: 2019-04-01
  ref <313>: RELEVANT RESIDUES IN SEQ ID NO: (1)..(1556)

SEQ ID NO: 2111 - DNA, 1411 bp, Bradyrhizobium sp. MOS004
  ref <308>: DATABASE ACCESSION NUMBER: NCBI ACCESSION: NZ_PYFV01000062.1
  ref <309>: DATABASE ENTRY DATE: 2019-04-01
  ref <313>: RELEVANT RESIDUES IN SEQ ID NO: (1)..(1411)
gtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttcta

SEQ ID NO: 2112 - DNA, 1497 bp, Bradyrhizobium sp. NAS80.1
  ref <308>: DATABASE ACCESSION NUMBER: NCBI ACCESSION: NZ_LGHL01000474.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2113 - DNA, 1497 bp, Bradyrhizobium sp. NAS96.2
  ref <308>: DATABASE ACCESSION NUMBER: NCBI ACCESSION: NZ_LGHK01000096.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2114 - DNA, 1497 bp, Bradyrhizobium sp. OHSU III; identical to SEQ ID NO: 2113
  ref <308>: DATABASE ACCESSION NUMBER: NCBI ACCESSION: NZ_APJD01000004.1
  ref <309>: DATABASE ENTRY DATE: 2019-04-01
  ref <313>: RELEVANT RESIDUES IN SEQ ID NO: (1)..(1497)

SEQ ID NO: 2115 - DNA, 1497 bp, Bradyrhizobium sp. ORS 278
  ref <308>: DATABASE ACCESSION NUMBER: NCBI ACCESSION: NC_009445.1
  ref <309>: DATABASE ENTRY DATE: 2019-04-01
  ref <313>: RELEVANT RESIDUES IN SEQ ID NO: (1)..(1497)
ttcaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtggggtaatggcccaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtttgggaccggtcgcagagacgtgaccttctcttcggagcccgaaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacagtgggaagctaaggggtgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 2116 - DNA, 1497 bp, Bradyrhizobium sp. ORS 285
  ref <308>: DATABASE ACCESSION NUMBER: NCBI ACCESSION: NZ_LT859959.1
  ref <309>: DATABASE ENTRY DATE: 2019-04-01
  ref <313>: RELEVANT RESIDUES IN SEQ ID NO: (1)..(1497)
ttcaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtggggtaatggcccaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtttgggaccggtcgcagagacgtgaccttctcttcggagcccgaaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacagtgggaagctaaggggtgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 2117 - DNA, 1495 bp, Bradyrhizobium sp. ORS 3257
  ref <308>: DATABASE ACCESSION NUMBER: NCBI ACCESSION: NZ_LS398110.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacccagggaaacttgggctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaa

SEQ ID NO: 2118 - DNA, 1497 bp, Bradyrhizobium sp. ORS 375; identical to SEQ ID NO: 2115
  ref <308>: DATABASE ACCESSION NUMBER: NCBI ACCESSION: NZ_CAFI01000413.1
  ref <309>: DATABASE ENTRY DATE: 2019-04-01
  ref <313>: RELEVANT RESIDUES IN SEQ ID NO: (1)..(1497)

SEQ ID NO: 2119 - DNA, 1495 bp, Bradyrhizobium sp. RP6
  ref <308>: DATABASE ACCESSION NUMBER: NCBI ACCESSION: NZ_RQIT01000011.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaa

SEQ ID NO: 2120 - DNA, 1497 bp, Bradyrhizobium sp. S23321
  ref <308>: DATABASE ACCESSION NUMBER: NCBI ACCESSION: NC_017082.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaaggtagtgcgctaacccgcaagggaggcagctaaccacggtagggtcagcgactggggtgaagtcgtaacaaggtagccgtaggggaacctgcggctggatcacctcctttctaagg

SEQ ID NO: 2121 - DNA, 1494 bp, Bradyrhizobium sp. SK17
  ref <308>: DATABASE ACCESSION NUMBER: NCBI ACCESSION: NZ_CP025113.1
  ref <309>: DATABASE ENTRY DATE: 2019-04-01
  ref <313>: RELEVANT RESIDUES IN SEQ ID NO: (1)..(1494)
tccaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaactgagggaaacttcagctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttcta

SEQ ID NO: 2122 - DNA, 1497 bp, Bradyrhizobium sp. STM 3809
  ref <308>: DATABASE ACCESSION NUMBER: NCBI ACCESSION: NZ_CAFJ01000195.1
  ref <309>: DATABASE ENTRY DATE: 2019-04-01
  ref <313>: RELEVANT RESIDUES IN SEQ ID NO: (1)..(1497)
ttcaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtggggtaatggcccaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtttgggaccggtcgcagagacgtgaccttctcttcggagcccgaaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacagtgggaagctaaggggtgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 2123 - DNA, 1497 bp, Bradyrhizobium sp. STM 3843
  ref <308>: DATABASE ACCESSION NUMBER: NCBI ACCESSION: NZ_CAFK01000252.1
  ref <309>: DATABASE ENTRY DATE: 2019-04-01
  ref <313>: RELEVANT RESIDUES IN SEQ ID NO: (1)..(1497)
ttcaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtggggtaacggcccaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgatgcacgaaagcgtggggagcaaacaggattagataccctggtagtccacgccgtaaacgatgaatgccagccgttggtgggtttactcaccagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtctgggaccggtcgcagagatgtgaccttctcttcggagcccggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcgaagacgcaagtcctagcaaatctcaaaaaaccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 2124 - DNA, 1493 bp, Bradyrhizobium sp. SUTN9-2
  ref <308>: DATABASE ACCESSION NUMBER: NCBI ACCESSION: NZ_LAXE01000001.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttct

SEQ ID NO: 2125 - DNA, 1493 bp, Bradyrhizobium sp. TSA1
  ref <308>: DATABASE ACCESSION NUMBER: NCBI ACCESSION: NZ_LFJC01000003.1
  ref <309>: DATABASE ENTRY DATE: 2019-04-01
  ref <313>: RELEVANT RESIDUES IN SEQ ID NO: (1)..(1493)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttct

SEQ ID NO: 2126 - DNA, 1497 bp, Bradyrhizobium sp. Tv2a-2
  ref <308>: DATABASE ACCESSION NUMBER: NCBI ACCESSION: NZ_AXAI01000013.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccgggaccggtcgcagagacgtgaccttctcttcggagcccggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacagtgggatgcgaagacgcaagtcctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggctttacctgaaggcggtgcgctaaccagcaatggaggcagccgaccacggtagggtcagcgactggggtgaagtcgtaacaaggtagccgtaggggaacctgcggctggatcacctcctttctaagg

SEQ ID NO: 2127 - DNA, 1494 bp, Bradyrhizobium sp. UASWS1016; identical to SEQ ID NO: 2121
  ref <308>: DATABASE ACCESSION NUMBER: NCBI ACCESSION: NZ_MDEP01000038.1
  ref <309>: DATABASE ENTRY DATE: 2019-04-01
  ref <313>: RELEVANT RESIDUES IN SEQ ID NO: (1)..(1494)

SEQ ID NO: 2128 - DNA, 1497 bp, Bradyrhizobium sp. UFLA 03-321; identical to SEQ ID NO: 2113
  ref <308>: DATABASE ACCESSION NUMBER: NCBI ACCESSION: NZ_MPVQ01000039.1
  ref <309>: DATABASE ENTRY DATE: 2019-04-01
  ref <313>: RELEVANT RESIDUES IN SEQ ID NO: (1)..(1497)

SEQ ID NO: 2129 - DNA, 1499 bp, Bradyrhizobium sp. URHA0002
  ref <308>: DATABASE ACCESSION NUMBER: NCBI ACCESSION: NZ_AUES01000021.1
  ref <309>: DATABASE ENTRY DATE: 2019-04-01
  ref <313>: RELEVANT RESIDUES IN SEQ ID NO: (1)..(1499)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaacggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2130 - DNA, 1497 bp, Bradyrhizobium sp. URHA0013
  ref <308>: DATABASE ACCESSION NUMBER: NCBI ACCESSION: NZ_JADK01000003.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 2131 - DNA, 1497 bp, Bradyrhizobium sp. URHD0069
  ref <308>: DATABASE ACCESSION NUMBER: NCBI ACCESSION: NZ_JNIJ01000042.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacccagggaaacttgggctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagtccttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgcgaaggcgcaagccctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgcaaggaggcagccggccacggtagggtcagcgactggggtgaagtcgtaacaaggtagccgtaggggaacctgcggctggatcacctcctttctaagg

SEQ ID NO: 2132 - DNA, 1497 bp, Bradyrhizobium sp. WSM1253; identical to SEQ ID NO: 2130
  ref <308>: DATABASE ACCESSION NUMBER: NCBI ACCESSION: NZ_JH600073.1
  ref <309>: DATABASE ENTRY DATE: 2019-04-01
  ref <313>: RELEVANT RESIDUES IN SEQ ID NO: (1)..(1497)

SEQ ID NO: 2133 - DNA, 1497 bp, Bradyrhizobium sp. WSM1417
  ref <308>: DATABASE ACCESSION NUMBER: NCBI ACCESSION: NZ_KI911783.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggacgctaaggggcaacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2134 - DNA, 1497 bp, Bradyrhizobium sp. WSM1743
  ref <308>: DATABASE ACCESSION NUMBER: NCBI ACCESSION: NZ_AXAZ01000016.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2135 - DNA, 1497 bp, Bradyrhizobium sp. WSM2254
  ref <308>: DATABASE ACCESSION NUMBER: NCBI ACCESSION: NZ_AXAB01000017.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaacggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 2136 - DNA, 1497 bp, Bradyrhizobium sp. WSM2793
  ref <308>: DATABASE ACCESSION NUMBER: NCBI ACCESSION: NZ_KB902769.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2137 - DNA, 1497 bp, Bradyrhizobium sp. WSM3983
  ref <308>: DATABASE ACCESSION NUMBER: NCBI ACCESSION: NZ_AXAY01000005.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacataccttttggttcggaacaacacagggaaacttgtgctaataccggataagcccttacggggaaagatttatcgccgaaagattggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccagcaatggaggcagccggccacggtagggtcagcgactggggtgaagtcgtaacaaggtagccgtaggggaacctgcggctggatcacctcctttctaagg

SEQ ID NO: 2138 - DNA, 1497 bp, Bradyrhizobium sp. WSM4349; identical to SEQ ID NO: 2133
  ref <308>: DATABASE ACCESSION NUMBER: NCBI ACCESSION: NZ_KB890498.1
  ref <309>: DATABASE ENTRY DATE: 2019-04-01
  ref <313>: RELEVANT RESIDUES IN SEQ ID NO: (1)..(1497)

SEQ ID NO: 2139 - DNA, 1497 bp, Bradyrhizobium sp. WSM471; identical to SEQ ID NO: 2133
  ref <308>: DATABASE ACCESSION NUMBER: NCBI ACCESSION: NZ_CM001442.1
  ref <309>: DATABASE ENTRY DATE: 2019-04-01
  ref <313>: RELEVANT RESIDUES IN SEQ ID NO: (1)..(1497)

SEQ ID NO: 2140 - DNA, 1499 bp, Bradyrhizobium sp. th.b2
  ref <308>: DATABASE ACCESSION NUMBER: NCBI ACCESSION: NZ_AUGA01000007.1
  ref <309>: DATABASE ENTRY DATE: 2019-04-01
  ref <313>: RELEVANT RESIDUES IN SEQ ID NO: (1)..(1499)
tccaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagatggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2141 - DNA, 1495 bp, Bradyrhizobium stylosanthis
  ref <308>: DATABASE ACCESSION NUMBER: NCBI ACCESSION: NZ_LVEM01000016.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtagggtaatggcctaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccttctcttcggagcctggaacacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggaagcgaaggggcaacccctagcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2142 - DNA, 1495 bp, Bradyrhizobium tropiciagri; identical to SEQ ID NO: 2055
  ref <308>: DATABASE ACCESSION NUMBER: NCBI ACCESSION: NZ_LFLZ01000084.1
  ref <309>: DATABASE ENTRY DATE: 2019-04-01
  ref <313>: RELEVANT RESIDUES IN SEQ ID NO: (1)..(1495)

SEQ ID NO: 2143 - DNA, 1497 bp, Bradyrhizobium valentinum
  ref <308>: DATABASE ACCESSION NUMBER: NCBI ACCESSION: NZ_LLXX01000218.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacccagggaaacttgggctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagatggagttcttcagttcggctggaccggagacaggtgctgcatggctgtcgtcagctcgtgtcgtgagatgttgggttaagtcccgcaacgagcgcaacccccgtccttagttgctaccattcagttgagcactctaaggagactgccggtgataagccgcgaggaaggtggggatgacgtcaagtcctcatggcccttacgggctgggctacacacgtgctacaatggcggtgacaatgggatgctaaggggtgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaagg

SEQ ID NO: 2144 - DNA, 1495 bp, Bradyrhizobium vignae; identical to SEQ ID NO: 2117
  ref <308>: DATABASE ACCESSION NUMBER: NCBI ACCESSION: NZ_RDQF01000051.1
  ref <309>: DATABASE ENTRY DATE: 2019-04-01
  ref <313>: RELEVANT RESIDUES IN SEQ ID NO: (1)..(1495)

SEQ ID NO: 2145 - DNA, 1495 bp, Bradyrhizobium viridifuturi
  ref <308>: DATABASE ACCESSION NUMBER: NCBI ACCESSION: NZ_LGTB01000028.1
  ref <309>: DATABASE ENTRY DATE: 2019-04-01
  ref <313>: RELEVANT RESIDUES IN SEQ ID NO: (1)..(1495)
tccaacttgagagtttgatcctggctcagagcgaacgctggcggcaggcttaacacatgcaagtcgagcgggcatagcaatatgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatcccggtcgcggactccagagacggagttcttcagttcggctggaccggagacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaaccgaaagggggcagccggccacggtagggtcagcgactggggtgaagtcgtaacaaggtagccgtaggggaacctgcggctggatcacctcctttctaa

SEQ ID NO: 2146 - DNA, 1497 bp, Bradyrhizobium yuanmingense
  ref <308>: DATABASE ACCESSION NUMBER: NCBI ACCESSION: NZ_FMAE01000002.1
  ref <309>: DATABASE ENTRY DATE: 2019-04-01
  ref <313>: RELEVANT RESIDUES IN SEQ ID NO: (1)..(1497)
tccaacttgagagtttgatcctggctcagagcgaacgctggcggcaggcttaacacatgcaagtcgagcgggcgtagcaatacgtcagcggcagacgggtgagtaacgcgtgggaacgtaccttttggttcggaacaacacagggaaacttgtgctaataccggataagcccttacggggaaagatttatcgccgaaagatcggcccgcgtctgattagctagttggtgaggtaatggctcaccaaggcgacgatcagtagctggtctgagaggatgatcagccacattgggactgagacacggcccaaactcctacgggaggcagcagtggggaatattggacaatgggggcaaccctgatccagccatgccgcgtgagtgatgaaggccctagggttgtaaagctcttttgtgcgggaagataatgacggtaccgcaagaataagccccggctaacttcgtgccagcagccgcggtaatacgaagggggctagcgttgctcggaatcactgggcgtaaagggtgcgtaggcgggtctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacaggattagataccctggtagtccacgccgtaaacgatgaatgccagccgttagtgggtttactcactagtggcgcagctaacgctttaagcattccgcctggggagtacggtcgcaagattaaaactcaaaggaattgacgggggcccgcacaagcggtggagcatgtggtttaattcgacgcaacgcgcagaaccttaccagcccttgacatgtccaggaccggtcgcagagatgtgaccctctcttcggagcctggagcacaggtgctgcatggctgtcgtcagctcgtgtcgtgagatgttgggttaagtcccgcaacgagcgcaacccccgtccttagttgctaccatttagttgagcactctaaggagactgccggtgataagccgcgaggaaggtggggatgacgtcaagtcctcatggcccttacgggctgggctacacacgtgctacaatggcggtgacaatgggatgctaaggggcgacccttcgcaaatctcaaaaagccgtctcagttcggattgggctctgcaactcgagcccatgaagttggaatcgctagtaatcgtggatcagcacgccacggtgaatacgttcccgggccttgtacacaccgcccgtcacaccatgggagttggttttacctgaagacggtgcgctaacccgcaagggaggcagccggccacggtagggtcagcgactggggtgaagtcgtaacaaggtagccgtaggggaacctgcggctggatcacctcctttctaagg

SEQ ID NO: 2147 - DNA, 1543 bp, Brenneria alni
  ref <308>: DATABASE ACCESSION NUMBER: NCBI ACCESSION: NZ_MJLZ01000003.1
  ref <309>: DATABASE ENTRY DATE: 2019-04-01
  ref <313>: RELEVANT RESIDUES IN SEQ ID NO: (1)..(1543)
aaattgaagagtttgatcatggctcagattgaacgctggcggcaggcctaacacatgcaagtcgggcggtagcacaggggagcttgcttcctgggtgacgagcggcggacgggtgagtaaagtctgggaaactgcctgatggagggggataactactggaaacggtagctaataccgcataatgtcttcggaccaaagtgggggaccttagggcctcacgccatcggatgtgcccagatgggattagctggtaggtggggtaaaggctcacctaggcgacgatccctagctggtctgagaggatgaccagccacactggaactgagacacggtccagactcctacgggaggcagcagtggggaatattgcacaatgggggaaaccctgatgcagccatgccgcgtgtgtgaagaaggccttagggttgtaaagcactttcagcggggaggaaggcaatgagcttaataagcttgttgattgacgttacccgcagaagaagcaccggctaactccgtgccagcagccgcggtaatacggagggtgcaagcgttaatcggaatgactgggcgtaaagggcacgcaggcggtttgttaagtcagatgtgaaatccccgggcttaacctgggaactgcatttgaaactggcaagctggagtcttgtagaggggggtagaattccaggtgtagcggtgaaatgcgtagagatctggaggaataccggtggcgaaggcggccccctggacaaagactgacgctgaggtgcgaaagcgtggggagcaaacaggattagataccctggtagtccacgctgtaaacgatgtcgacttgaaggttgtggccttgagccgtggctttcggagcaaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcctcagaagagactggagacagttttgtgccttcgggaactgagagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgagcctgcgagggtgagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaacctcagggggggcgcttaccactttgtgattcatgactggggtgaagtcgtaacaaggtaaccgtaggggaacctgcggttggatcacctcctta

SEQ ID NO: 2148 - DNA, 1544 bp, Brenneria goodwinii
  ref <308>: DATABASE ACCESSION NUMBER: NCBI ACCESSION: NZ_MJLX01000061.1
  ref <309>: DATABASE ENTRY DATE: 2019-04-01
  ref <313>: RELEVANT RESIDUES IN SEQ ID NO: (1)..(1544)
aaattgaagagtttgatcatggctcagattgaacgctggcggcaggcctaacacatgcaagtcgagcggcagcgggaagaagcttgcttctttgccggcgagcggcggacgggtgagtaaagtctggggatctgcccgatggagggggataactactggaaacggtagctaataccgcataacgtcgcaagaccaaagtgggggaccttagggcctcacaccatcggatgaacccagatgggattagctagtaggcggggtaagggcccacctaggcgacgatccctagctggtctgagaggatgaccagccacactggaactgagacacggtccagactcctacgggaggcagcagtggggaatattgcacaatgggggaaaccctgatgcagccatgccgcgtgtatgaagaaggccttcgggttgtaaagtactttcagcggggaggaaggggatagggttaataaccttattcattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaagactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgtggtcttgaaccgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaagtttgcagagatgcgaatgtgccttcgggagctctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagtaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttacc

SEQ ID NO: 2149 - DNA, 1543 bp, Brenneria salicis
  ref <308>: DATABASE ACCESSION NUMBER: NCBI ACCESSION: NZ_MJMA01000033.1
  ref <309>: DATABASE ENTRY DATE: 2019-04-01
  ref <313>: RELEVANT RESIDUES IN SEQ ID NO: (1)..(1543)
aaattgaagagtttgatcatggctcagattgaacgctggcggcaggcctaacacatgcaagtcgggcggtagcacagaggagcttgctccttgggtgacgagcggcggacgggtgagtaaagtctggggatctgcctgatggagggggataactactggaaacggtagctaataccgcatgacgtcttcggaccaaagtgggggaccttcgggcctcacgccatgagatgaacccagatgggattagctggtaggtgaggtaacggctcacctaggcgacgatccctagctggtctgagaggatgaccagccacactggaactgagacacggtccagactcctacgggaggcagcagtggggaatattgcacaatgggggaaaccctgatgcagccatgccgcgtgtgtgaagaaggccttcgggttgtaaagcactttcagcggggaggaaggcgataaacttaataagtttgttgattgacgttacccgcagaagaagcaccggctaactccgtgccagcagccgcggtaatacggagggtgcaagcgttaatcggaatgactgggcgtaaagcgcacgcaggcggtgtgttaagttggatgtgaaatccccgggctcaacccgggaacagcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgtggtcttgaaccgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaagactgtagagatacggttgtgccttcgggagctctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgcatacaaagagaagcgagcctgcgagggtgagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttagggggggcgcttaccactttgtgattcatgactggggtgaagtcgtaacaaggtaaccgtaggggaacctgcggttggatcacctcctta

SEQ ID NO: 2150 - DNA, 1496 bp, Breoghania corrubedonensis
  ref <308>: DATABASE ACCESSION NUMBER: NCBI ACCESSION: NZ_QAYG01000020.1
  ref <309>: DATABASE ENTRY DATE: 2019-04-01
  ref <313>: RELEVANT RESIDUES IN SEQ ID NO: (1)..(1496)
tcaacttgagagtttgatcctggctcagaacgaacgctggcggcaggcttaacacatgcaagtcgaacgcactcttcggagtgagtggcagacgggtgagtaacgcgtgggaacatacccaatggtacggaacaactgagggaaacttcagctaataccgtatgtgccctaagggggaaagatttatcgccattggattggcccgcgttggattagctagatggtgtggtaatggcgcaccatggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcagtcgtgaagataatgacattagcgacagaagaagccccggctaacttcgtgccagcagccgcggtaatacgaagggggctagcgttgttcggaatcactgggcgtaaagcgcacgtaggcggacatttaagtcaggggtgaaatcccggggctcaaccccggaactgcctttgatactggatgtctagagaccgagagaggtgagtggaactccgagtgtagaggtgaaattcgtagatattcggaagaacaccagtggcgaaggcggctcactggctcggtactgacgctgaggtgcgaaagcgtggggagcaaacaggattagataccctggtagtccacgccgtaaacgatggaagctagctgtcgggcagcatgctgttcggtggcgcagttaacgcattaagcttcccgcctggggagtacggtcgcaagattaaaactcaaaggaattgacgggggcccgcacaagcggtggagcatgtggtttaattcgaagcaacgcgcagaaccttaccagctcttgacatcccgatcgcggaaagtggagacattttccttcagttaggctggatcggagacaggtgctgcatggctgtcgtcagctcgtgtcgtgagatgttgggttaagtcccgcaacgagcgcaaccctcgcccttagttgccagcattcagttgggcactctagggggactgccggtgataagccggaggaaggtggggatgacgtcaagtcctcatggcccttacgggctgggctacacacgtgctacaatggcggtgacagtgggcagcgaactcgcgagagtgagctaatctccaaaaaccgtctcagttcggattgcactctgcaactcgggtgcatgaagttggaatcgctagtaatcgcggatcagcatgccgcggtgaatacgttcccgggccttgtacacaccgcccgtcacaccatgggagttggttctacccgaaggcgttgcgctaacctggcaacaggaggcaggcgaccacggtagggtcagcgactggggtgaagtcgtaacaaggtagccgtaggggaacctgcggctggatcacctcctttctaag

SEQ ID NO: 2151 - DNA, 1541 bp, Brevibacillus choshinensis
  ref <308>: DATABASE ACCESSION NUMBER: NCBI ACCESSION: NZ_LJJB01000010.1
  ref <309>: DATABASE ENTRY DATE: 2019-04-01
  ref <313>: RELEVANT RESIDUES IN SEQ ID NO: (1)..(1541)
ctttattggagagtttgatcctggctcaggacgaacgctggcggcgtgcctaatacatgcaagtcgagcgagtctcttcggaggctagcggcggacgggtgagtaacacgtaggcaacctgcctctcagactgggataacatagggaaacttatgctaataccggataggtttttggatcgcatgatccgaaaagaaaaggcggcttcggctgtcactgggagatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaacaagtaccgttcgaatagggcggtaccttgacggtacctgacgagaaagccacggctaactacgtgccagcagccgcggtaatacgtaggtggcaagcgttgtccggatttattgggcgtaaagcgcgcgcaggcggctatgtaagtctggtgttaaagcccggagctcaactccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttatttctagttgccagcattcagttgggcactctagagagactgccgtcgacaagacggaggaaggcggggatgacgtcaaatcatcatgccccttatgacctgggctacacacgtgctacaatggttggtacaacgggatgctacctcgcgaggggacgccaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagatgactggggtgaagtcgtaacaaggtatccgtaccggaaggtgcggatggatcacctcctttcta

SEQ ID NO: 2152 - DNA, 1465 bp, Brevibacillus sp. SKDU10
  ref <308>: DATABASE ACCESSION NUMBER: NCBI ACCESSION: NZ_LSSO01000209.1
  ref <309>: DATABASE ENTRY DATE: 2019-04-01
  ref <313>: RELEVANT RESIDUES IN SEQ ID NO: (1)..(1465)
ttcggaccctagcggcggacgggtgagtaacacgtaggcaacctgcctgcaagactgggataacatagggaaacttatgctaataccggatagagttttgcttcgcatgaagcgaaacggaaagatggcgcaagctatcacttgcagatgggcctgcggcgcattagctagttggtgaggtaaaggctcaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctttcgggtcgtaaagttctgttgttagggaagaaacagtgccatttgaataagatggcgccttgacggtacctaacgagaaagccacggctaactacgtgccagcagccgcggtaatacgtaggtggcaagcgttgtccggaattattgggcgtaaagcgcgcgcaggtggctatgtaagtctgatgttaaagcccgaggctcaacctcggttcgcattggaaactgcgtagcttgagtgcaggagaggaaagtggtattccacgtgtagcggtgaaatgcgtagagatgtggaggaacaccagtggcgaaggcgactttctggcctgtaactgacactgaggcgcgaaagcgtggggagcaaacaggattagataccctggtagtccacgccgtaaacgatgagtgctaggtgttaggggtttcaatacccttagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccactgaccgctctagagatagagcttcccttcggggcagtggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggttggtacaacgggatgctacttcgcgagaagatgctaatctcttaaaaccaatctcagttcggattgtaggctgcaactcgcctacatgaagtcggaatcgctagtaatcgcggatcagcatgccgcggtgaatacgttcccgggccttgtacacaccgcccgtcacaccacgggagtttgcaacacccgaagtcggtgaggtaaccgcaaggagccagccgccgaaggtggggtagataactggggtgaagtcgtaacaaggtatccgtaccggaaggtgcggatggatcacctcctttcta

SEQ ID NO: 2153 - DNA, 1019 bp, Brevibacillus sp. WF146
  ref <308>: DATABASE ACCESSION NUMBER: NCBI ACCESSION: NZ_LXGJ01000357.1
  ref <309>: DATABASE ENTRY DATE: 2019-04-01
  ref <313>: RELEVANT RESIDUES IN SEQ ID NO: (1)..(1019)
ctttattggagagtttgatcctggctcaggacgaacgctggcggcgtgcctaatacatgcaagtcgagcggacctgtttggagcttgcttcagacaggttagcggcggacgggtgagtaacacgtaggcaacctgcccgcaagaccgggataacgtagggaaacttacgctaataccggatagggcaccttctcgcatgagagggtgcggaaaggtggcgcaagctaccacttgcggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatgggcgaaagcctgatggagcaacgccgcgtgaacgatgaaggtcttcggattgtaaagttctgttgtcagggacgaacaagtaccgttcgaacagggcggtaccttgacggtacctgacgagaaagccccggctaactacgtgccagcagccgcggtaatacgtagggggcaagcgttgtccggaattattgggcgtaaagcgcgcgcaggcggtcgggtaagtctgatgtcaaagcccggggctcaaccccggtacgcattggaaactgctcgacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccg

SEQ ID NO: 2154 - DNA, 1591 bp, Brevibacillus thermoruber
  ref <308>: DATABASE ACCESSION NUMBER: NCBI ACCESSION: NZ_JQMH01000016.1
  ref <309>: DATABASE ENTRY DATE: 2019-04-01
  ref <313>: RELEVANT RESIDUES IN SEQ ID NO: (1)..(1591)
ctttattggagagtttgatcctggctcaggacgaacgctggcggcgtgcctaatacatgcaagtcgagcggacctgtttggagcttgcttcagacaggttagcggcggacgggtgagtaacacgtaggcaacctgcctgcaagaccgggataacgtagggaaacttacgctaataccggatagggcaccttctcgcatgagagggtgcggaaaggtggcgcaagctaccacttgtggatgggcctgcggcgcattagctagttggtggggtaacggcctaccaaggcgacgatgcgtagccgacctgagagggtgaccggccacactgggactgagacacggcccagactcctacgggaggcagcagtagggaattttccacaatgggcgaaagcctgatggagcaacgccgcgtgaacgatgaaggtcttcggattgtaaagttctgttgtcagggacgaacaagtaccgttcgaacagggcggtaccttgacggtacctgacgagaaagccccggctaactacgtgccagcagccgcggtaatacgtagggggcaagcgttgtccggaattattgggcgtaaagcgcgcgcaggcggtcgggtaagtctgatgtcaaagcccggggctcaaccccggtacgcattggaaactgctcgacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaggtgttgggggtttcaataccctcagtgccgcagctaacgcaataagcactccgcctggggagtacgctcgcaagagtgaaactcaaaggaattgacgggggcccgcacaagcggtggagcatgtggtttaattcgaagcaacgcgaagaaccttaccaggtcttgacatcccgctgaccgccctagagatagggcttcccttcggggcagcggtgacaggtggtgcatggttgtcgtcagctcgtgtcgtgagatgttgggttaagtcccgcaacgagcgcaacccttatctttagttgccagcattcagttgggcactctagagagactgccgtcgacaagacggaggaaggcggggatgacgtcaaatcatcatgccccttatgacctgggctacacacgtgctacaatggctggtacaacgggacgcaagcccgcgagggtaagccaatctcttaaaaccagtctcagttcggattgcaggctgcaactcgcctgcatgaagtcggaatcgctagtaatcgcggatcagcatgccgcggtgaatacgttcccgggccttgtacacaccgcccgtcacaccacgagagtttgcaacacccgaagtcggtgaggtaacctataccaccccaaaaagtaatactttttggggacccggttgggagccagccgccgaaggtggggtagatgattggggtgaagtcgtaacaaggtatccgtaccggaaggtgcggatggatcacctcctttct

SEQ ID NO: 2155 - DNA, 1537 bp, Brevibacterium iodinum
  ref <308>: DATABASE ACCESSION NUMBER: NCBI ACCESSION: NZ_UFTQ01000001.1
  ref <309>: DATABASE ENTRY DATE: 2019-04-01
  ref <313>: RELEVANT RESIDUES IN SEQ ID NO: (1)..(1537)
tttatggagagtttgatcctggctcaggacgaacgctggctgcgtgcttaacacatgcaagtcgaacgctgaagccagaagcttgcttctggtggatgagtggcgaacgggtgagtaacacgtgagtaacctgcccctgatttcgggataagcctgggaaactgggtctaataccggatacgaccaaccctcgcatgagggttggtggaaagtttttcgatcagggatgggctcgcggcctatcagcttgttggtggggtaatggcccaccaaggcgacgacgggtagccggcctgagagggcgaccggccacactgggactgagacacggcccagactcctacgggaggcagcagtggggaatattgcacaatgggggaaaccctgatgcagcgacgcagcgtgcgggatgacggccttcgggttgtaaaccgctttcagcagggaagaagcgaaagtgacggtacctgcagaagaagtaccggctaactacgtgccagcagccgcggtaatacgtagggtacgagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacaggattagataccctggtagtccatgccgtaaacgttgggcactaggtgtgggggacattccacgttctccgcgccgtagctaacgcattaagtgccccgcctggggagtacggtcgcaaggctaaaactcaaaggaattgacgggggcccgcacaagcggcggagcatgcggattaattcgatgcaacgcgaagaaccttaccaaggcttgacatacactggaccgttctggaaacagttcttctctttggagctggtgtacaggtggtgcatggttgtcgtcagctcgtgtcgtgagatgttgggttaagtcccgcaacgagcgcaaccctcgttctatgttgccagcacgtgatggtgggaactcataggagactgccggggtcaactcggaggaaggtggggatgacgtcaaatcatcatgccctttatgtcttgggcttcacgcatgctacaatggctggtacagagagaggcgaacccgtgagggtaagcgaatcccttaaagccagtctcagttcggatcgtagtctgcaattcgactacgtgaagtcggagtcgctagtaatcgcagatcagcaacgctgcggtgaatacgttcccgggccttgtacacaccgcccgtcaagtcacgaaagtcggtaacacccgaagccggtgtcccaaccccttttttggggagggggccgtctaaggtgggactggtgattgggactaagtcgtaacaaggtagccgtaccggaaggtgcggctggatcacctcctttctaagga

SEQ ID NO: 2156 - DNA, 1467 bp, Brevirhabdus pacifica
  ref <308>: DATABASE ACCESSION NUMBER: NCBI ACCESSION: NZ_PGFI01000011.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcacgcctaacacatgcaagtcgagcgccctcttcggagggagcggcggacgggttagtaacgcgtgggaacatacccttttctacggaatagcctcgggaaactgagagtaataccgtatacgccctacgggggaaagatttatcggtgaaggattggcccgcgttggattaggtagttggtggggtaatggcctaccaagcctacgatccatagctggtttgagaggatgatcagcaacactgggactgagacacggcccagactcctacgggaggcagcagtggggaatcttagacaatgggcgcaagcctgatctagcgatgccgcgtgagtgacgaaggccttagggtcgtaaagctctttcgccagggatgataatgacagtacctggtaaagaagtcccggctaactccgtgccagcagccgcggtaatacggaggggactagcgttgttcggaattactgggcgtaaagcgtacgtaggcggattagttagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtacgaaagtgtggggagcaaacaggattagataccctggtagtccacaccgtaaacgatgaatgccagacgtcgggcagtatactgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgggaccgccagagagatctggttttcacttcggtgacccggtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacgacgctgcgctaaccttcggggggcaggcggccacggtaggatcagcgactggggtgaagtcgtaacaaggtagccgtaggggaacctgcggctggatcacctcctttctaa

SEQ ID NO: 2157 - DNA, 1493 bp, Brevundimonas aveniformis
  ref <308>: DATABASE ACCESSION NUMBER: NCBI ACCESSION: NZ_AUAO01000001.1
  ref <309>: DATABASE ENTRY DATE: 2019-04-01
  ref <313>: RELEVANT RESIDUES IN SEQ ID NO: (1)..(1493)
tcaacttgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggctcaccaaggcaacgatcagtagctggtctgagaggatgaccagccacattgggactgagacacggcccaaactcctacgggaggcagcagtggggaatcttgcgcaatgggcgaaagcctgacgcagccatgccgcgtggatgatgaaggtcttaggattgtaaaatcctttcaccggtgaagataatgactgtagccggagaagaagccccggctaacttcgtgccagcagccgcggtaatacgaagggggctagcgttgctcggatttactgggcgtaaagggcgcgtaggcggacatttaagtcaggggtgaaatcccggggctcaacctcggaactgcctttgatactggatgtcttgagtgtgagagaggtgtgtggaactccgagtgtagaggtgaaattcgtagatattcggaagaacaccagtggcgaaggcgacacactggctcattactgacgctgaggcgcgaaagcgtggggagcaaacaggattagataccctggtagtccacgccgtaaacgatgattgctagttgtcgggatgcatgcatctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgcctttagttgccatcattcagttgggcactctaaagggactgccggtgctaagccggaggaaggtggggatgacgtcaagtcctcatggcccttacggggtgggctacacacgtgctacaatggcgactacagagggctgcaacccagcgatggtgagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaaggatgc

SEQ ID NO: 2158 - DNA, 1464 bp, Brevundimonas bacteroides
  ref <308>: DATABASE ACCESSION NUMBER: NCBI ACCESSION: NZ_JNIX01000007.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgggctcttcggagctagtggcggacgggtgagtaacacgtgggaacgtgcctttaggttcggaataagcccgggaaactgggtctaataccggatgtgcccttcgggggaaagatttatcgcctttagagcggcccgcgtctgattagctagttggtggtgtaatggaccaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcaggggtgaaatcccggggctcaacctcggaactgcctttgatactgggtgtcttgagtgtgatagaggtatgtggaactccgagtgtagaggtgaaattcgtagatattcggaagaacaccagtggcgaaggcgacatactggatcattactgacgctgaggctcgaaagcgtggggagcaaacaggattagataccctggtagtccacgccgtaaacgatgattgctagttgtcggggtgtttacatctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgcgtgagagatcacgctttcccttcggggactaggacacaggtgctgcatggctgtcgtcagctcgtgtcgtgagatgttgggttaagtcccgcaacgagcgcaaccctcgccattagttgccatcattcagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaagggggcaggcgaccacggtagggtcagcgactggggtgaagtcgtaacaaggtagccgtaggggaacctgcggctggatcacctcctttcta

SEQ ID NO: 2159 - DNA, 1466 bp, Brevundimonas diminuta
  ref <308>: DATABASE ACCESSION NUMBER: NCBI ACCESSION: NZ_UIGE01000001.1
  ref <309>: DATABASE ENTRY DATE: 2019-04-01
  ref <313>: RELEVANT RESIDUES IN SEQ ID NO: (1)..(1466)
caacctgagagtttgatcctggctcagagcgaacgctggcggcaggcctaacacatgcaagtcgaacggacccttcggggttagtggcggacgggtgagtaacacgtgggaacgtgcctttaggttcggaatagctcctggaaacgggtggtaatgccgaatgtgcccttcgggggaaagatttatcgcctttagagcggcccgcgtctgattagctagttggtgaggtaacggctcaccaaggcgacgatcagtagctggtctgagaggatgaccagccacactgggactgagacacggcccagactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggatcgttaagtcagaggtgaaatcccagggctcaaccctggaactgcctttgatactggcgatcttgagtatgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcaactacagagggttaatccttaaaagttgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtagccgtaggggaacctgcggctggatcacctcctttcta

SEQ ID NO: 2160 - DNA, 1466 bp, Brevundimonas halotolerans
  ref <308>: DATABASE ACCESSION NUMBER: NCBI ACCESSION: NZ_QTTA01000016.1
  ref <309>: DATABASE ENTRY DATE: 2019-04-01
  ref <313>: RELEVANT RESIDUES IN SEQ ID NO: (1)..(1466)
caacctgagagtttgatcctggctcagagcgaacgctggcggcaggcctaacacatgcaagtcgaacggactcttcggagttagtggcggacgggtgagtaacacgtgggaacgtgcctttaggttcggaataagcccgggaaactgggtctaataccgaatgtgcccttcgggggaaagatttatcgcctttagagcggcccgcgtctgattagctagttggtagtgtaatggactaccaaggctacgatcagtagctggtctgagaggatgaccagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggacatttaagtcaggggtgaaatcccagagctcaactctggaactgcctttgatactgggtgtcttgagtgtgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggatcgccacggagacgtggttttcccttcggggaccaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatcccaaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccgtaggggaacctgcggctggatcacctcctttcta

SEQ ID NO: 2161 - DNA, 1466 bp, Brevundimonas naejangsanensis
  ref <308>: DATABASE ACCESSION NUMBER: NCBI ACCESSION: NZ_CP032707.1
  ref <309>: DATABASE ENTRY DATE: 2019-04-01
  ref <313>: RELEVANT RESIDUES IN SEQ ID NO: (1)..(1466)
caacctgagagtttgatcctggctcagagcgaacgctggcggcaggcctaacacatgcaagtcgaacgaactcttcggagttagtggcggacgggtgagtaacacgtgggaacgtgccttttggttcggaataactcagggaaacttgtgctaataccgaatgtgcccttcgggggaaagatttatcgccattagagcggcccgcgtctgattagctagttggtgaggtaacggctcaccaaggcgacgatcagtagctggtctgagaggatggccagccacactgggactgagacacggcccagactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggatcgttaagtcaggggtgaaatcccggggctcaacctcggaactgcccttgatactggcgatcttgagtatgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtagccgtaggggaacctgcggctggatcacctcctttcta

SEQ ID NO: 2162 - DNA, 1464 bp, Brevundimonas nasdae
  ref <308>: DATABASE ACCESSION NUMBER: NCBI ACCESSION: NZ_JWSY01000038.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggcttaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcgggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacaggattagataccctggtagtccacgccgtaaacgatgattgctagttgtcgggatgcatgcatttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttcta

SEQ ID NO: 2163 - DNA, 1464 bp, Brevundimonas sp. AAP58
  ref <308>: DATABASE ACCESSION NUMBER: NCBI ACCESSION: NZ_LJHU01000014.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgggctcttcggagctagtggcggacgggtgagtaacacgtgggaacgtgcctttaggttcggaataagcccgggaaactgggtctaataccggatgtgcccttcgggggaaagatttatcgcctttagagcggcccgcgtctgattagctagttggtggtgtaatggaccaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcaggggtgaaatcccggggctcaacctcggaactgcctttgatactgggtgtcttgagtgtgatagaggtatgtggaactccgagtgtagaggtgaaattcgtagatattcggaagaacaccagtggcgaaggcgacatactggatcattactgacgctgaggctcgaaagcgtggggagcaaacaggattagataccctggtagtccacgccgtaaacgatgattgctagttgtcggggtgtttacacctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgcgtgagagatcacgctttcccttcggggactaggacacaggtgctgcatggctgtcgtcagctcgtgtcgtgagatgttgggttaagtcccgcaacgagcgcaaccctcgccattagttgccatcattcagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaagggggcaggcgaccacggtagggtcagcgactggggtgaagtcgtaacaaggtagccgtaggggaacctgcggctggatcacctcctttcta

SEQ ID NO: 2164 - DNA, 1464 bp, Brevundimonas sp. BAL3
  ref <308>: DATABASE ACCESSION NUMBER: NCBI ACCESSION: NZ_DS989898.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcagtagggacgataatgacggtacctacagaagaagccccggctaacttcgtgccagcagccgcggtaatacgaagggggctagcgttgctcggaattactgggcgtaaagggagcgtaggcggacatttaagtcaggggtgaaatcccggggctcaacctcggaattgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggatgcatgcatttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaagggggcaggcgaccacggtagggtcagcgactggggtgaagtcgtaacaaggtagccgtaggggaacctgcggctggatcacctcctttcta

SEQ ID NO: 2165 - DNA, 1464 bp, Brevundimonas sp. DS20
  ref <308>: DATABASE ACCESSION NUMBER: NCBI ACCESSION: NZ_CP012897.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgaagtcttcggacttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcaggggtgaaatcccggggctcaacctcggaattgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggatgcatgcatttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcccggaccgccacagagatgtggctttctcttcggagactgggacacaggtgctgcatggctgtcgtcagctcgtgtcgtgagatgttgggttaagtcccgcaacgagcgcaaccctcgccattagttgccatcattcagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttcta

SEQ ID NO: 2166 - DNA, 1464 bp, Brevundimonas sp. EAKA; identical to SEQ ID NO: 2164
  ref <308>: DATABASE ACCESSION NUMBER: NCBI ACCESSION: NZ_JMQR01000157.1
  ref <309>: DATABASE ENTRY DATE: 2019-04-01
  ref <313>: RELEVANT RESIDUES IN SEQ ID NO: (1)..(1464)

SEQ ID NO: 2167 - DNA, 1464 bp, Brevundimonas sp. GW460-12-10-14-LB2
  ref <308>: DATABASE ACCESSION NUMBER: NCBI ACCESSION: NZ_CP015511.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcaggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacaggattagataccctggtagtccacgccgtaaacgatgattgctagttgtcgggatgcatgcatttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttcta

SEQ ID NO: 2168 - DNA, 1464 bp, Brevundimonas sp. KM4
  ref <308>: DATABASE ACCESSION NUMBER: NCBI ACCESSION: NZ_JZRG01000024.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcaggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacaggattagataccctggtagtccacgccgtaaacgatgattgctagttgtcgggatgcatgcatttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttcta

SEQ ID NO: 2169 - DNA, 1464 bp, Brevundimonas sp. LA-55
  ref <308>: DATABASE ACCESSION NUMBER: NCBI ACCESSION: NZ_RQWJ01000003.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgaggtcttcggacctagtggcggacgggtgagtaacacgtgggaacgtgccctttggtacggaataactcagggaaacttgagctaataccgtatgtgcccttcgggggaaagatttatcgccattggagcggcccgcgtctgattagctagttggtgaggtaatggctcaccaaggcgacgatcagtagctggtctgagaggatgaccagccacattgggactgagacacggcccaaactcctacgggaggcagcagtggggaatcttgcgcaatgggcgaaagcctgacgcagccatgccgcgtggatgatgaaggtcttaggattgtaaaatcctttcaccggtgaagataatgactgtagccggagaagaagccccggctaacttcgtgccagcagccgcggtaatacgaagggggctagcgttgctcggaattactgggcgtaaagggcgcgtaggcggacatttaagtcaggggtgaaatcccagagctcaactctggaactgcctttgatactggatgtcttgagtgtgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcccggaccgcaccggagacggtgctttcccttcggggaccgggacacaggtgctgcatggctgtcgtcagctcgtgtcgtgagatgttgggttaagtcccgcaacgagcgcaaccctcgccattagttgccatcattcagttgggaactctaatgggactgccggtgctaagccggaggaaggtggggatgacgtcaagtcctcatggcccttacagggtgggctacacacgtgctacaatggcgactacagagggataatccctaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaagggggcaggcgaccacggtagggtcagcgactggggtgaagtcgtaacaaggtagccgtaggggaacctgcggctggatcacctcctttcta

SEQ ID NO: 2170 - DNA, 1465 bp, Brevundimonas sp. LM2
  ref <308>: DATABASE ACCESSION NUMBER: NCBI ACCESSION: NZ_CP019508.1
  ref <309>: DATABASE ENTRY DATE: 2019-04-01
  ref <313>: RELEVANT RESIDUES IN SEQ ID NO: (1)..(1465)
caacctgagagtttgatcctggctcagagcgaacgctggcggcaggcctaacacatgcaagtcgaacggacctttcggggttagtggcggacgggtgagtaacacgtgggaacgtgccttttggttcggaatagctcctggaaacgggtggtaatgccgaatgtgccctttgggggaaagatttatcgccattagagcggcccgcgtctgattagctagttggtgaggtaaaggctcaccaaggcgacgatcagtagctggtctgagaggatgaccagccacattgggactgagacacggcccaaactcctacgggaggcagcagtggggaatcttgcgcaatgggcgaaagcctgacgcagccatgccgcgtgtatgatgaaggtcttaggattgtaaaatactttcaccggtgaagataatgactgtagccggagaagaagccccggctaacttcgtgccagcagccgcggtaatacgaagggggctagcgttgctcggaattactgggcgtaaagggagcgtaggcggacatttaagtcaggggtgaaatcccagagctcaactctggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggatgtttacatctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacctcctttctaa

SEQ ID NO: 2171 - DNA, 1466 bp, Brevundimonas sp. LPMIX5
  ref <308>: DATABASE ACCESSION NUMBER: NCBI ACCESSION: NZ_QWTZ01000020.1
  ref <309>: DATABASE ENTRY DATE: 2019-04-01
  ref <313>: RELEVANT RESIDUES IN SEQ ID NO: (1)..(1466)
caacctgagagtttgatcctggctcagagcgaacgctggcggcaggcctaacacatgcaagtcgaacgaactcttcggagttagtggcggacgggtgagtaacacgtgggaacgtgccttttggttcggaataactcagggaaacttgtgctaataccgaatgtgcccttcgggggaaagatttatcgccattagagcggcccgcgtctgattagctagttggtgaggtaaaagctcaccaaggcgacgatcagtagctggtctgagaggatggccagccacactgggactgagacacggcccagactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggatcgttaagtcagaggtgaaatcccagggctcaaccctggaactgcctttgatactggcgatcttgagtatgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtagccgtaggggaacctgcggctggatcacctcctttcta

SEQ ID NO: 2172 - DNA, 1464 bp, Brevundimonas sp. Leaf168
  ref <308>: DATABASE ACCESSION NUMBER: NCBI ACCESSION: NZ_LMOY01000013.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcaggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacaggattagataccctggtagtccacgccgtaaacgatgattgctagttgtcgggatgcatgcatttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcattaagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctgaccgcaaggaggcaggcgaccacggtagggtcagcgactggggtgaagtcgtaacaaggtagccgtaggggaacctgcggctggatcacctcctttcta

SEQ ID NO: 2173 - DNA, 1464 bp, Brevundimonas sp. Leaf280; identical to SEQ ID NO: 2167
  ref <308>: DATABASE ACCESSION NUMBER: NCBI ACCESSION: NZ_LMNC01000003.1
  ref <309>: DATABASE ENTRY DATE: 2019-04-01
  ref <313>: RELEVANT RESIDUES IN SEQ ID NO: (1)..(1464)

SEQ ID NO: 2174 - DNA, 1464 bp, Brevundimonas sp. Leaf363
  ref <308>: DATABASE ACCESSION NUMBER: NCBI ACCESSION: NZ_LMPZ01000003.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacggatccttcgggattagtggcggacgggtgagtaacacgtgggaacgtgccttttggttcggaataactcagggaaacttgtgctaataccgaatgtgcccttcgggggaaagatttatcgccattagagcggcccgcgtctgattagctagttggtgaggtaaaggctcaccaaggctacgatcagtagctggtctgagaggatgaccagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggacatttaagtcaggggtgaaatcccagagctcaactctggaactgcctttgatactggatgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcggggagtttactcttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccacggagacgtggctttctcttcggagactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacctcctttcta

SEQ ID NO: 2175 - DNA, 1528 bp, Brevundimonas sp. MYb27
  ref <308>: DATABASE ACCESSION NUMBER: NCBI ACCESSION: NZ_PCPO01000063.1
  ref <309>: DATABASE ENTRY DATE: 2019-04-01
  ref <313>: RELEVANT RESIDUES IN SEQ ID NO: (1)..(1528)
tcaacggagagtttgatcctggctcaggatgaacgctggcggcgtgcttaacacatgcaagtcgaacgatgatcccagcttgctgggggattagtggcgaacgggtgagtaacacgtgagtaacctgcccttgactctgggataagcctgggaaactgggtctaataccggatacgaccatctggcgcatgtcatggtggtggaaagcttttgtggttttggatggactcgcggcctatcagcttgttggtggggtaatggcctaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcgccggctaactacgtgccagcagccgcggtaatacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtgggggacattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaagacctggaaacaggtgccccgcttgcggtcggtttacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggacgacgtcaaatcatcatgccccttatgtcttgggcttcacgcatgctacaatggccggtacaaagggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggaccggcgattgggactaagtcgtaacaaggtagccgtaccggaaggtgcggctggatcacctcctttctaagga

SEQ ID NO: 2176 - DNA, 1464 bp, Brevundimonas sp. MYb31
  ref <308>: DATABASE ACCESSION NUMBER: NCBI ACCESSION: NZ_PCPM01000048.1
  ref <309>: DATABASE ENTRY DATE: 2019-04-01
  ref <313>: RELEVANT RESIDUES IN SEQ ID NO: (1)..(1464)
caacctgagagtttgatcctggctcagagcgaacgctggcggcaggcctaacacatgcaagtcgaacggacccttcggggttagtggcggacgggtgagtaacacgtgggaacgtgcctttaggttcggaatagctcctggaaacgggtggtaatgccgaatgtgcccttcgggggaaagatttatcgcctttagagcggcccgcgtctgattagctagttggtgaggtaatggctcaccaaggcgacgatcagtagctggtctgagaggatgaccagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggacatttaagtcaggggtgaaatcccagagctcaactctggaactgcctttgatactggatgtcttgagtgtgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttctcttcggagactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaaccgtaaggaggcagtcgaccacggtagggtcagcgactggggtgaagtcgtaacaaggtagccgtaggggaacctgcggctggatcacctcctttcta

SEQ ID NO: 2177 - DNA, 1464 bp, Brevundimonas sp. MYb33; identical to SEQ ID NO: 2176
  ref <308>: DATABASE ACCESSION NUMBER: NCBI ACCESSION: NZ_PCPK01000062.1
  ref <309>: DATABASE ENTRY DATE: 2019-04-01
  ref <313>: RELEVANT RESIDUES IN SEQ ID NO: (1)..(1464)

SEQ ID NO: 2178 - DNA, 1464 bp, Brevundimonas sp. MYb46; identical to SEQ ID NO: 2176
  ref <308>: DATABASE ACCESSION NUMBER: NCBI ACCESSION: NZ_PCPF01000034.1
  ref <309>: DATABASE ENTRY DATE: 2019-04-01
  ref <313>: RELEVANT RESIDUES IN SEQ ID NO: (1)..(1464)

SEQ ID NO: 2179 - DNA, 1464 bp, Brevundimonas sp. MYb52; identical to SEQ ID NO: 2176
  ref <308>: DATABASE ACCESSION NUMBER: NCBI ACCESSION: NZ_PCPB01000030.1
  ref <309>: DATABASE ENTRY DATE: 2019-04-01
  ref <313>: RELEVANT RESIDUES IN SEQ ID NO: (1)..(1464)

SEQ ID NO: 2180 - DNA, 1488 bp, Brevundimonas sp. NS26
  ref <308>: DATABASE ACCESSION NUMBER: NCBI ACCESSION: NZ_QUOQ01000004.1
  ref <309>: DATABASE ENTRY DATE: 2019-04-01
  ref <313>: RELEVANT RESIDUES IN SEQ ID NO: (1)..(1488)
caacctgagagtttgatcctggctcagagcgaacgctggcggcaggcctaacacatgcaagtcgaacggacccttcggggttagtggcggacgggtgagtaacacgtgggaacgtgccctttggttcggaataagctcgggaaactgggtctaataccgaatgtgcccttcgggggaaagatttatcgccaaaggagcggcccgcgtctgattagctagttggtggtgtaaaggaccaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggacatttaagtcaggggtgaaatcccggggctcaacctcggaattgcctttgatactgggtgtcttgagtatgagagaggtatgtggaactccgagtgtagaggtgaaattcgtagatattcggaagaacaccagtggcgaaggcgacatactggctcattactgacgctgaggcgcgaaagcgtggggagcaaacaggattagataccctggtagtccacgccgtaaacgatgattgctagttgtcgggctgcatgcagttcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcattaagttgggcactctagtgggactgccggtgctaagccggaggaaggtggggatgacgtcaagtcctcatggcccttacggggtgggctacacacgtgctacaatggcgactacagagggctgcaaaccagcgatggtgagccaatcccaaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtagccgtaggggaacctgcggctggatcacctcctttctaa

SEQ ID NO: 2181 - DNA, 1466 bp, Brevundimonas sp. Root1279
  ref <308>: DATABASE ACCESSION NUMBER: NCBI ACCESSION: NZ_LMEB01000005.1
  ref <309>: DATABASE ENTRY DATE: 2019-04-01
  ref <313>: RELEVANT RESIDUES IN SEQ ID NO: (1)..(1466)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtgaggtaaaggctcaccaaggcgacgatcagtagctggtctgagaggatgaccagccacattgggactgagacacggcccaaactcctacgggaggcagcagtggggaatcttgcgcaatgggcgaaagcctgacgcagccatgccgcgtgtatgatgaaggtcttaggattgtaaaatactttcaccggtgaagataatgactgtagccggagaagaagccccggctaacttcgtgccagcagccgcggtaatacgaagggggctagcgttgctcggaattactgggcgtaaagggagcgtaggcggacatttaagtcagaggtgaaatcccggagcttaacttcggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggaagcttgcttctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcccggaccgccagagagatctggctttcccttcggggactgggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcggtgcgctaaccagcaatggaggcagccgaccacggtagggtcagcgactggggtgaagtcgtaacaaggtagccgtaggggaacctgcggctggatcacctcctttcta

SEQ ID NO: 2182 - DNA, 1431 bp, Brevundimonas sp. Root1423
  ref <308>: DATABASE ACCESSION NUMBER: NCBI ACCESSION: NZ_LMFL01000023.1
  ref <309>: DATABASE ENTRY DATE: 2019-04-01
  ref <313>: RELEVANT RESIDUES IN SEQ ID NO: (1)..(1431)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagctagttggtaaggtaatggcttaccaaggctacgatcagtagctggtctgagaggatgaccagccacattgggactgagacacggcccaaactcctacgggaggcagcagtggggaatcttgcgcaatgggcgaaagcctgacgcagccatgccgcgtgtatgatgaaggtcttaggattgtaaaatactttcaccggtgaagataatgactgtagccggagaagaagccccggctaacttcgtgccagcagccgcggtaatacgaagggggctagcgttgctcggaattactgggcgtaaagggagcgtaggcggacatttaagtcagaggtgaaatcccggagcttaacttcggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggaagcttgcttctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgccyggaccgccasagagatstggctttcccttcggggactrggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgt

SEQ ID NO: 2183 - DNA, 1466 bp, Brevundimonas sp. Root608
  ref <308>: DATABASE ACCESSION NUMBER: NCBI ACCESSION: NZ_LMGT01000001.1
  ref <309>: DATABASE ENTRY DATE: 2019-04-01
  ref <313>: RELEVANT RESIDUES IN SEQ ID NO: (1)..(1466)
caacctgagagtttgatcctggctcagagcgaacgctggcggcaggcctaacacatgcaagtcgaacgaactcttcggagttagtggcggacgggtgagtaacacgtgggaacgtgcctttaggttcggaataactcagggaaacttgtgctaataccgaatgtgcccttcgggggaaagatttatcgcctttagagcggcccgcgtctgattagcttgttggtggggtaatggcccaccaaggctacgatcagtagctggtctgagaggatgaccagccacattgggactgagacacggcccaaactcctacgggaggcagcagtggggaatcttgcgcaatgggcgaaagcctgacgcagccatgccgcgtgtatgatgaaggtcttaggattgtaaaatactttcaccggtgaagataatgactgtagccggagaagaagccccggctaacttcgtgccagcagccgcggtaatacgaagggggctagcgttgctcggaattactgggcgtaaagggagcgtaggcggacatttaagtcagaggtgaaatcccggagcttaacttcggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggaagcttgcttctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccgtaggggaacctgcggctggatcacctcctttcta

SEQ ID NO: 2184 - DNA, 1466 bp, Brevundimonas sp. ZS04; identical to SEQ ID NO: 2159
  ref <308>: DATABASE ACCESSION NUMBER: NCBI ACCESSION: NZ_MTHE01000031.1
  ref <309>: DATABASE ENTRY DATE: 2019-04-01
  ref <313>: RELEVANT RESIDUES IN SEQ ID NO: (1)..(1466)

SEQ ID NO: 2185 - DNA, 1465 bp, Brevundimonas subvibrioides
  ref <308>: DATABASE ACCESSION NUMBER: NCBI ACCESSION: NC_014375.1
  ref <309>: DATABASE ENTRY DATE: 2019-04-01
  ref <313>: RELEVANT RESIDUES IN SEQ ID NO: (1)..(1465)
caacctgagagtttgatcctggctcagagcgaacgctggcggcaggcctaacacatgcaagtcgaacggacctctcggggttagtggcggacgggtgagtaacacgtgggaacgtgccttttggttcggaatagctcctggaaacgggtggtaatgccgaatgtgccctttgggggaaagatttatcgccattagagcggcccgcgtctgattagctagttggtgaggtaaaggctcaccaaggctacgatcagtagctggtctgagaggatgaccagccacattgggactgagacacggcccaaactcctacgggaggcagcagtggggaatcttgcgcaatgggcgaaagcctgacgcagccatgccgcgtgtatgatgaaggtcttaggattgtaaaatactttcaccggtgaagataatgactgtagccggagaagaagccccggctaacttcgtgccagcagccgcggtaatacgaagggggctagcgttgctcggaattactgggcgtaaagggagcgtaggcggacatttaagtcaggggtgaaatcccagagctcaactctggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacaggattagataccctggtagtccacgccgtaaacgatgattgctagttgtcgggatgtttacatctcggtgacgcagctaacgcattaagcaatccgcctggggagtacggtcgcaagattaaaactcaaaggaattgacgggggcccgcacaagcggtggagcatgtggtttaattcgaagcaacgcgcagaaccttaccaccttttgacatgcctggaccgccagagagatctggctttcccttcggggactaggacacaggtgctgcatggctgtcgtcagctcgtgtcgtgagatgttgggttaagtcccgcaacgagcgcaaccctcgccattagttgccatcatttagttgggaactctaatgggactgccggtgctaagccggaggaaggtggggatgacgtcaagtcctcatggcccttacagggtgggctacacacgtgctacaatggcgactacagagggttaatccttaaaagtcgtctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacctcctttctaa

SEQ ID NO: 2186 - DNA, 1557 bp, Brochothrix campestris
  ref <308>: DATABASE ACCESSION NUMBER: NCBI ACCESSION: NZ_AODH01000086.1
  ref <309>: DATABASE ENTRY DATE: 2019-04-01
  ref <313>: RELEVANT RESIDUES IN SEQ ID NO: (1)..(1557)
ttttaacgagagtttgatcctggctcaggacgaacgctggcggcgtgcctaatacatgcaagtcgaacgaacggataaggagcttgctcctttgaagttagtggcggacgggtgagtaacacgtgggtaacctgcctcacagctggggataacatcgagaaatcgatgctaataccgaatgtgctgaacatcataagatgttcaagtgaaagacggtttcggctgtcactgtgagatggacccgcgctggattagctagttggtaaggtaatggcttaccaaggcgacgatccatagccgacctgagagggtgatcggccacattgggactgagacacggcccaaactcctacgggaggcagcagtagggaatcttcggcaatggacgaaagtctgaccgagcaacgccgcgtgagcgaagaaggccttcgggtcgtaaagctctgttgttagagaagaacaagggtgagagtaactgttcaccccttgacggtatctaaccagaaagccacggctaactacgtgccagcagccgcggtaatacgtaggtggcaagcgttgtccggaattattgggcgtaaagcgcgcgcaggcggtcttttaagtctgatgtgaaagcccccggctcaaccggggagggtcattggaaactggaagacttgaggacagaagaggagagtggaattccaagtgtagcggtgaaatgcgtagatatttggaggaacaccagtggcgaaggcggctctctggtctgttactgacgctgaggcgcgaaagcgtggggagcaaacaggattagataccctggtagtccacgccgtaaacgatgagtgctaagtgttagggggtttccgccccttagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccttgattttagttgccagcattaagttgggcactctaaagtgactgccggtgtaagccggaggaaggtggggatgacgtcaaatcatcatgccccttatgacctgggctacacacgtgctacaatggataatacaaagggtcgcgaagccgcgaggtggagccaatcccataaaattattctcagttcggattgcaggctgcaactcgcctgcatgaagccggaatcgctagtaatcgtagatcagcatgctacggtgaatacgttcccgggccttgtacacaccgcccgtcacaccacgagagtttgtaacacccaaagccggtttggtaaccttcgggagctagccgtctaaggtgggatagataattggggtgaagtcgtaacaaggtagccgtatcggaaggtgcggctggatcacctcctttctaaggaa

SEQ ID NO: 2187 - DNA, 1556 bp, Brochothrix thermosphacta
  ref <308>: DATABASE ACCESSION NUMBER: NCBI ACCESSION: NZ_OOIK01000030.1
  ref <309>: DATABASE ENTRY DATE: 2019-04-01
  ref <313>: RELEVANT RESIDUES IN SEQ ID NO: (1)..(1556)
tttaacgagagtttgatcctggctcaggacgaacgctggcggcgtgcctaatacatgcaagtcgaacgaacggataaagagcttgctcttttgaagttagtggcggacgggtgagtaacacgtgggtaacctgcctcacagctggggataacatcgagaaatcgatgctaataccgaatgtgctgaacatcataagatgttcaagtgaaagacggtttcggctgtcactgtgagatggacccgcgctggattagctagttggtaaggtaatggcttaccaaggcgacgatccatagccgacctgagagggtgatcggccacattgggactgagacacggcccaaactcctacgggaggcagcagtagggaatcttcggcaatggacgaaagtctgaccgagcaacgccgcgtgagcgaagaaggccttcgggtcgtaaagctctgttgttagagaagaacatgggtgagagtaactgttcaccccttgacggtatctaaccagaaagccacggctaactacgtgccagcagccgcggtaatacgtaggtggcaagcgttgtccggaattattgggcgtaaagcgcgcgcaggcggtctcttaagtctgatgtgaaagcccccggctcaaccggggagggtcattggaaactgggagacttgaggacagaagaggagagtggaattccaagtgtagcggtgaaatgcgtagatatttggaggaacaccagtggcgaaggcggctctctggtctgttactgacgctgaggcgcgaaagcgtggggagcaaacaggattagataccctggtagtccacgccgtaaacgatgagtgctaagtgttagggggtttccgccccttagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccttgattttagttgccagcatttagttgggcactctaaagtgactgccggtgtaagccggaggaaggtggggatgacgtcaaatcatcatgccccttatgacctgggctacacacgtgctacaatggataatacaaagggtcgcgaagccgcgaggtggagccaatcccataaaattattctcagttcggattgcaggctgcaactcgcctgcatgaagccggaatcgctagtaatcgtagatcagcatgctacggtgaatacgttcccgggccttgtacacaccgcccgtcacaccacgagagtttgtaacacccaaagccggtttggtaaccttcgggagctagccgtctaaggtgggatagataattggggtgaagtcgtaacaaggtagccgtatcggaaggtgcggctggatcacctcctttctaaggaa

SEQ ID NO: 2188 - DNA, 1518 bp, Brockia lithotrophica
  ref <308>: DATABASE ACCESSION NUMBER: NCBI ACCESSION: NZ_RBIJ01000011.1
  ref <309>: DATABASE ENTRY DATE: 2019-04-01
  ref <313>: RELEVANT RESIDUES IN SEQ ID NO: (1)..(1518)
tacggagagtttgatcctggctcaggacgaacgctggcggcgcgcctaatacatgcaagtcgagcggggtagcgcaagctacctagcggcggacgggtgagtaacgcgtaggtaacctacccgcaggactgggacaaccctgggaaaccggggctaatcctggatagatccgctgggcgcatgcttagcggaggaaagggcggaagcccgcctgcggaggggcctgcgtcccatcagctagttggtggggtaacggcccaccaaggcgatgacgggtagccggcctgagagggtggacggccacaccgggactgagacacggcccggactcctacgggaggcagcagtagggaatcttccgcaatgggcggaagcctgacggagcgacgccgcgtgggggaggaaggccttcgggtcgtaaacccctgttgtcggggaagagggcttgccagtgggcgagctggacggtacccgacgaggaagccccggctaactacgtgccagcagccgcggtaagacgtagggggcgagcgttgtccggaatgactgggcgtaaagggcgcgtaggcggccgagtaagccctgtgtgaaaggccacggctcaaccgtggaggtgcgcaggggactgcttggctagagggcgggagagggaagtggaattcccggtgtagcggtgaaatgcgtagatatcgggaggaacaccagtggcgaaggcggcttcctggcccggccctgacgctgaggcgcgagagctgggggagcgaaccggattagatacccgggtagtcccagccgtaaacgatgggcgctaggtgtgggggtgaggaacctccgtgccgcaggtaacccagtaagcgccccgcctggggagtacggccgcaaggctgaaactcaaaggaattgacgggggcccgcacaagcggtggagcatgtggtttaattcgatgcaacgcgaagaaccttaccagggcttgacatgcaggtggtagcgagccgaaaggtgagcgaccctgtcatagggcagggagcctgcacaggtggtgcatggttgtcgtcagctcgtgtcgtgagatgttgggttaagtcccgcaacgagcgcaacccctgcccctagttgccagcgggtaaggccgggcactctagggggactgccgccgacgaggcggaggaaggcggggatgacgtcaaatcatcatgccccttaagccctgggctacacacgtgctacaatggccggtacagcgggaagcgaagccgcgaggcggagcggaaccctgaaagccggtcgtagttcggattgcaggctgcaactcgcctgcatgaaggcggaatcgctagtaatcgcggatcagcatgccgcggtgaatacgttcccgggccttgtacacaccgcccgtcacaccatgggagtcggcaacacctgaaggcttgcgcagggctgagggtggggccggcgactggggtgaagtcgtaacaaggtatccgtaccggaaggtgcggatggatcacctcctttct

SEQ ID NO: 2189 - DNA, 1493 bp, Brucella inopinata
  ref <308>: DATABASE ACCESSION NUMBER: NCBI ACCESSION: NZ_ADEZ01000047.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 2190 - DNA, 1493 bp, Brucella microti
  ref <308>: DATABASE ACCESSION NUMBER: NCBI ACCESSION: NC_013119.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 2191 - DNA, 1491 bp, Brucella neotomae
  ref <308>: DATABASE ACCESSION NUMBER: NCBI ACCESSION: NZ_UIGH01000002.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagttaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 2192 - DNA, 1491 bp, Brucella ovis
  ref <308>: DATABASE ACCESSION NUMBER: NCBI ACCESSION: NZ_UFUD01000002.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 2193 - DNA, 1493 bp, Brucella pinnipedialis; identical to SEQ ID NO: 2190
  ref <308>: DATABASE ACCESSION NUMBER: NCBI ACCESSION: NZ_CP007743.1
  ref <309>: DATABASE ENTRY DATE: 2019-04-01
  ref <313>: RELEVANT RESIDUES IN SEQ ID NO: (1)..(1493)

SEQ ID NO: 2194 - DNA, 1493 bp, Brucella sp. 04-5288; identical to SEQ ID NO: 2190
  ref <308>: DATABASE ACCESSION NUMBER: NCBI ACCESSION: NZ_KI518510.1
  ref <309>: DATABASE ENTRY DATE: 2019-04-01
  ref <313>: RELEVANT RESIDUES IN SEQ ID NO: (1)..(1493)

SEQ ID NO: 2195 - DNA, 1549 bp, Brucella sp. 09RB8471
  ref <308>: DATABASE ACCESSION NUMBER: NCBI ACCESSION: NZ_CP019346.1
  ref <309>: DATABASE ENTRY DATE: 2019-04-01
  ref <313>: RELEVANT RESIDUES IN SEQ ID NO: (1)..(1549)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccccctttaaaattccaagaaacataaaatgccttggcattttatgggggggaaagatttatcggcaaatgatcggcccgcgttggattagctagttggtggggtaaaggcccaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcccaagcaattggatgggaggcaggcgaccacggtagggtcagcgactggggtgaagtcgtaacaaggtagccgtaggggaacctgcggctggatcacctcctttctaagg

SEQ ID NO: 2196 - DNA, 1493 bp, Brucella sp. 09RB8910; identical to SEQ ID NO: 2189
  ref <308>: DATABASE ACCESSION NUMBER: NCBI ACCESSION: NZ_CP019390.1
  ref <309>: DATABASE ENTRY DATE: 2019-04-01
  ref <313>: RELEVANT RESIDUES IN SEQ ID NO: (1)..(1493)

SEQ ID NO: 2197 - DNA, 1549 bp, Brucella sp. 141012304; identical to SEQ ID NO: 2195
  ref <308>: DATABASE ACCESSION NUMBER: NCBI ACCESSION: NZ_LT605585.1
  ref <309>: DATABASE ENTRY DATE: 2019-04-01
  ref <313>: RELEVANT RESIDUES IN SEQ ID NO: (1)..(1549)

SEQ ID NO: 2198 - DNA, 1493 bp, Brucella sp. 2002734562; identical to SEQ ID NO: 2190
  ref <308>: DATABASE ACCESSION NUMBER: NCBI ACCESSION: NZ_CP016979.1
  ref <309>: DATABASE ENTRY DATE: 2019-04-01
  ref <313>: RELEVANT RESIDUES IN SEQ ID NO: (1)..(1493)

SEQ ID NO: 2199 - DNA, 1493 bp, Brucella sp. 56 94; identical to SEQ ID NO: 2190
  ref <308>: DATABASE ACCESSION NUMBER: NCBI ACCESSION: NZ_KB850632.1
  ref <309>: DATABASE ENTRY DATE: 2019-04-01
  ref <313>: RELEVANT RESIDUES IN SEQ ID NO: (1)..(1493)

SEQ ID NO: 2200 - DNA, 1493 bp, Brucella sp. 63 311
  ref <308>: DATABASE ACCESSION NUMBER: NCBI ACCESSION: NZ_KB850615.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagctccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaagg

SEQ ID NO: 2201 - DNA, 1493 bp, Brucella sp. 83 13
  ref <308>: DATABASE ACCESSION NUMBER: NCBI ACCESSION: NZ_DS999656.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccgaaaggggaaagatttatcggcaaatgatcggcccgcgttggattagctagttggtggggtaaaggcccaccaaggcgacgatccatagctggtctgagaggatgatcagccacactgggactgagacacggcccagactcttacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggtaggcgaccacggtagggtcagcgactggggtgaagtcgtaacaaggtagccgtaggggaacctgcggctggatcacctcctttctaagg

SEQ ID NO: 2202 - DNA, 1493 bp, Brucella sp. B13-0095; identical to SEQ ID NO: 2189
  ref <308>: DATABASE ACCESSION NUMBER: NCBI ACCESSION: NZ_MAIL01000009.1
  ref <309>: DATABASE ENTRY DATE: 2019-04-01
  ref <313>: RELEVANT RESIDUES IN SEQ ID NO: (1)..(1493)

SEQ ID NO: 2203 - DNA, 1491 bp, Brucella sp. BCCN 84-3; identical to SEQ ID NO: 2192
  ref <308>: DATABASE ACCESSION NUMBER: NCBI ACCESSION: NZ_NQLX01000048.1
  ref <309>: DATABASE ENTRY DATE: 2019-04-01
  ref <313>: RELEVANT RESIDUES IN SEQ ID NO: (1)..(1491)

SEQ ID NO: 2204 - DNA, 1493 bp, Brucella sp. BO2; identical to SEQ ID NO: 2189
  ref <308>: DATABASE ACCESSION NUMBER: NCBI ACCESSION: NZ_ADFA01000067.1
  ref <309>: DATABASE ENTRY DATE: 2019-04-01
  ref <313>: RELEVANT RESIDUES IN SEQ ID NO: (1)..(1493)

SEQ ID NO: 2205 - DNA, 1493 bp, Brucella sp. CMUL 003; identical to SEQ ID NO: 2190
  ref <308>: DATABASE ACCESSION NUMBER: NCBI ACCESSION: NZ_MKPV01000019.1
  ref <309>: DATABASE ENTRY DATE: 2019-04-01
  ref <313>: RELEVANT RESIDUES IN SEQ ID NO: (1)..(1493)

SEQ ID NO: 2206 - DNA, 1493 bp, Brucella sp. CMUL 004; identical to SEQ ID NO: 2190
  ref <308>: DATABASE ACCESSION NUMBER: NCBI ACCESSION: NZ_MKPW01000031.1
  ref <309>: DATABASE ENTRY DATE: 2019-04-01
  ref <313>: RELEVANT RESIDUES IN SEQ ID NO: (1)..(1493)

SEQ ID NO: 2207 - DNA, 1493 bp, Brucella sp. CMUL 010; identical to SEQ ID NO: 2190
  ref <308>: DATABASE ACCESSION NUMBER: NCBI ACCESSION: NZ_MKXI01000035.1
  ref <309>: DATABASE ENTRY DATE: 2019-04-01
  ref <313>: RELEVANT RESIDUES IN SEQ ID NO: (1)..(1493)

SEQ ID NO: 2208 - DNA, 1493 bp, Brucella sp. CMUL 013; identical to SEQ ID NO: 2190
  ref <308>: DATABASE ACCESSION NUMBER: NCBI ACCESSION: NZ_MKXJ01000028.1
  ref <309>: DATABASE ENTRY DATE: 2019-04-01
  ref <313>: RELEVANT RESIDUES IN SEQ ID NO: (1)..(1493)

SEQ ID NO: 2209 - DNA, 1493 bp, Brucella sp. CMUL 014; identical to SEQ ID NO: 2190
  ref <308>: DATABASE ACCESSION NUMBER: NCBI ACCESSION: NZ_MKPX01000003.1
  ref <309>: DATABASE ENTRY DATE: 2019-04-01
  ref <313>: RELEVANT RESIDUES IN SEQ ID NO: (1)..(1493)

SEQ ID NO: 2210 - DNA, 1493 bp, Brucella sp. CMUL 015; identical to SEQ ID NO: 2190
  ref <308>: DATABASE ACCESSION NUMBER: NCBI ACCESSION: NZ_MKPY01000022.1
  ref <309>: DATABASE ENTRY DATE: 2019-04-01
  ref <313>: RELEVANT RESIDUES IN SEQ ID NO: (1)..(1493)

SEQ ID NO: 2211 - DNA, 1493 bp, Brucella sp. CMUL 018; identical to SEQ ID NO: 2190
  ref <308>: DATABASE ACCESSION NUMBER: NCBI ACCESSION: NZ_MKXK01000037.1
  ref <309>: DATABASE ENTRY DATE: 2019-04-01
  ref <313>: RELEVANT RESIDUES IN SEQ ID NO: (1)..(1493)

SEQ ID NO: 2212 - DNA, 1493 bp, Brucella sp. CMUL 024; identical to SEQ ID NO: 2190
  ref <308>: DATABASE ACCESSION NUMBER: NCBI ACCESSION: NZ_MNBM01000009.1
  ref <309>: DATABASE ENTRY DATE: 2019-04-01
  ref <313>: RELEVANT RESIDUES IN SEQ ID NO: (1)..(1493)

SEQ ID NO: 2213 - DNA, 1493 bp, Brucella sp. CMUL 025; identical to SEQ ID NO: 2190
  ref <308>: DATABASE ACCESSION NUMBER: NCBI ACCESSION: NZ_MKPZ01000021.1
  ref <309>: DATABASE ENTRY DATE: 2019-04-01
  ref <313>: RELEVANT RESIDUES IN SEQ ID NO: (1)..(1493)

SEQ ID NO: 2214 - DNA, 1493 bp, Brucella sp. CMUL 026; identical to SEQ ID NO: 2190
  ref <308>: DATABASE ACCESSION NUMBER: NCBI ACCESSION: NZ_MNBN01000030.1
  ref <309>: DATABASE ENTRY DATE: 2019-04-01
  ref <313>: RELEVANT RESIDUES IN SEQ ID NO: (1)..(1493)

SEQ ID NO: 2215 - DNA, 1493 bp, Brucella sp. CMUL 027; identical to SEQ ID NO: 2190
  ref <308>: DATABASE ACCESSION NUMBER: NCBI ACCESSION: NZ_MKQA01000012.1
  ref <309>: DATABASE ENTRY DATE: 2019-04-01
  ref <313>: RELEVANT RESIDUES IN SEQ ID NO: (1)..(1493)

SEQ ID NO: 2216 - DNA, 1493 bp, Brucella sp. CMUL 029; identical to SEQ ID NO: 2190
  ref <308>: DATABASE ACCESSION NUMBER: NCBI ACCESSION: NZ_MNBO01000026.1
  ref <309>: DATABASE ENTRY DATE: 2019-04-01
  ref <313>: RELEVANT RESIDUES IN SEQ ID NO: (1)..(1493)

SEQ ID NO: 2217 - DNA, 1493 bp, Brucella sp. CMUL 030; identical to SEQ ID NO: 2190
  ref <308>: DATABASE ACCESSION NUMBER: NCBI ACCESSION: NZ_MRUO01000032.1
  ref <309>: DATABASE ENTRY DATE: 2019-04-01
  ref <313>: RELEVANT RESIDUES IN SEQ ID NO: (1)..(1493)

SEQ ID NO: 2218 - DNA, 1493 bp, Brucella sp. CMUL 031; identical to SEQ ID NO: 2190
  ref <308>: DATABASE ACCESSION NUMBER: NCBI ACCESSION: NZ_MRUP01000003.1
  ref <309>: DATABASE ENTRY DATE: 2019-04-01
  ref <313>: RELEVANT RESIDUES IN SEQ ID NO: (1)..(1493)

SEQ ID NO: 2219 - DNA, 1493 bp, Brucella sp. CMUL 034; identical to SEQ ID NO: 2190
  ref <308>: DATABASE ACCESSION NUMBER: NCBI ACCESSION: NZ_MRUR01000040.1
  ref <309>: DATABASE ENTRY DATE: 2019-04-01
  ref <313>: RELEVANT RESIDUES IN SEQ ID NO: (1)..(1493)

SEQ ID NO: 2220 - DNA, 1493 bp, Brucella sp. CMUL 035; identical to SEQ ID NO: 2190
  ref <308>: DATABASE ACCESSION NUMBER: NCBI ACCESSION: NZ_MRUQ01000028.1
  ref <309>: DATABASE ENTRY DATE: 2019-04-01
  ref <313>: RELEVANT RESIDUES IN SEQ ID NO: (1)..(1493)

SEQ ID NO: 2221 - DNA, 1493 bp, Brucella sp. CMUL 036; identical to SEQ ID NO: 2190
  ref <308>: DATABASE ACCESSION NUMBER: NCBI ACCESSION: NZ_MKQB01000020.1
  ref <309>: DATABASE ENTRY DATE: 2019-04-01
  ref <313>: RELEVANT RESIDUES IN SEQ ID NO: (1)..(1493)

SEQ ID NO: 2222 - DNA, 1493 bp, Brucella sp. CMUL 08; identical to SEQ ID NO: 2190
  ref <308>: DATABASE ACCESSION NUMBER: NCBI ACCESSION: NZ_MLJL01000032.1
  ref <309>: DATABASE ENTRY DATE: 2019-04-01
  ref <313>: RELEVANT RESIDUES IN SEQ ID NO: (1)..(1493)

SEQ ID NO: 2223 - DNA, 1493 bp, Brucella sp. F23 97; identical to SEQ ID NO: 2190
  ref <308>: DATABASE ACCESSION NUMBER: NCBI ACCESSION: NZ_KB850664.1
  ref <309>: DATABASE ENTRY DATE: 2019-04-01
  ref <313>: RELEVANT RESIDUES IN SEQ ID NO: (1)..(1493)

SEQ ID NO: 2224 - DNA, 1493 bp, Brucella sp. F5 06; identical to SEQ ID NO: 2190
  ref <308>: DATABASE ACCESSION NUMBER: NCBI ACCESSION: NZ_KB850637.1
  ref <309>: DATABASE ENTRY DATE: 2019-04-01
  ref <313>: RELEVANT RESIDUES IN SEQ ID NO: (1)..(1493)

SEQ ID NO: 2225 - DNA, 1094 bp, Brucella sp. F5 99
  ref <308>: DATABASE ACCESSION NUMBER: NCBI ACCESSION: NZ_GG663476.1
  ref <309>: DATABASE ENTRY DATE: 2019-04-01
  ref <313>: RELEVANT RESIDUES IN SEQ ID NO: (1)..(1094)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactc

SEQ ID NO: 2226 - DNA, 1493 bp, Brucella sp. F8 99; identical to SEQ ID NO: 2190
  ref <308>: DATABASE ACCESSION NUMBER: NCBI ACCESSION: NZ_KB850772.1
  ref <309>: DATABASE ENTRY DATE: 2019-04-01
  ref <313>: RELEVANT RESIDUES IN SEQ ID NO: (1)..(1493)

SEQ ID NO: 2227 - DNA, 1493 bp, Brucella sp. F96 2; identical to SEQ ID NO: 2190
  ref <308>: DATABASE ACCESSION NUMBER: NCBI ACCESSION: NZ_KB850696.1
  ref <309>: DATABASE ENTRY DATE: 2019-04-01
  ref <313>: RELEVANT RESIDUES IN SEQ ID NO: (1)..(1493)

SEQ ID NO: 2228 - DNA, 1493 bp, Brucella sp. NF 2653; identical to SEQ ID NO: 2201
  ref <308>: DATABASE ACCESSION NUMBER: NCBI ACCESSION: NZ_ADFB01000082.1
  ref <309>: DATABASE ENTRY DATE: 2019-04-01
  ref <313>: RELEVANT RESIDUES IN SEQ ID NO: (1)..(1493)

SEQ ID NO: 2229 - DNA, 1006 bp, Brucella sp. NVSL 07-0026
  ref <308>: DATABASE ACCESSION NUMBER: NCBI ACCESSION: NZ_GG770509.1
  ref <309>: DATABASE ENTRY DATE: 2019-04-01
  ref <313>: RELEVANT RESIDUES IN SEQ ID NO: (1)..(1006)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttgtcggcaaatgatcggcccgcgttggattagctagttggtggggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtgcggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggct

SEQ ID NO: 2230 - DNA, 1493 bp, Brucella sp. UK1 97; identical to SEQ ID NO: 2190
  ref <308>: DATABASE ACCESSION NUMBER: NCBI ACCESSION: NZ_KB850727.1
  ref <309>: DATABASE ENTRY DATE: 2019-04-01
  ref <313>: RELEVANT RESIDUES IN SEQ ID NO: (1)..(1493)

SEQ ID NO: 2231 - DNA, 1493 bp, Brucella sp. UK38 05; identical to SEQ ID NO: 2190
  ref <308>: DATABASE ACCESSION NUMBER: NCBI ACCESSION: NZ_AQNR01000030.1
  ref <309>: DATABASE ENTRY DATE: 2019-04-01
  ref <313>: RELEVANT RESIDUES IN SEQ ID NO: (1)..(1493)

SEQ ID NO: 2232 - DNA, 1493 bp, Brucella sp. UK40 99; identical to SEQ ID NO: 2190
  ref <308>: DATABASE ACCESSION NUMBER: NCBI ACCESSION: NZ_KB850805.1
  ref <309>: DATABASE ENTRY DATE: 2019-04-01
  ref <313>: RELEVANT RESIDUES IN SEQ ID NO: (1)..(1493)

SEQ ID NO: 2233 - DNA, 1493 bp, Brucella sp. UK5 01; identical to SEQ ID NO: 2190
  ref <308>: DATABASE ACCESSION NUMBER: NCBI ACCESSION: NZ_AQNS01000018.1
  ref <309>: DATABASE ENTRY DATE: 2019-04-01
  ref <313>: RELEVANT RESIDUES IN SEQ ID NO: (1)..(1493)

SEQ ID NO: 2234 - DNA, 1491 bp, Brucella suis; identical to SEQ ID NO: 2192
  ref <308>: DATABASE ACCESSION NUMBER: NCBI ACCESSION: NZ_UFTY01000002.1
  ref <309>: DATABASE ENTRY DATE: 2019-04-01
  ref <313>: RELEVANT RESIDUES IN SEQ ID NO: (1)..(1491)

SEQ ID NO: 2235 - DNA, 1493 bp, Brucella vulpis
  ref <308>: DATABASE ACCESSION NUMBER: NCBI ACCESSION: NZ_LN997863.1
  ref <309>: DATABASE ENTRY DATE: 2019-04-01
  ref <313>: RELEVANT RESIDUES IN SEQ ID NO: (1)..(1493)
ttcaacttgagagtttgatcctggctcagaacgaacgctggcggcaggcttaacacatgcaagtcgagcgccccgcaaggggagcggcagacgggtgagtaacgcgtgggaacgtaccatttgctacggaataactcagggaaacttgtgctaataccgtatgtgcccttcgggggaaagatttatcggcaaatgatcggcccgcgttggattagctagttggtggggtaaaggcccaccaaggcgacgatccatagctggtctgagaggatgatcagccacactgggactgagacacggcccagactcctacgggaggcagcagtggggagtattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgtcggggtgtttacacttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggttagtggagacactatccttcagttaggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacggtatggtcagcgactggggtgaagtcgtaacaaggtagccgtaggggaacctgcggctggatcacctcctttctaagg

SEQ ID NO: 2236 - DNA, 1489 bp, Brucellaceae bacterium VT-16-1752
  ref <308>: DATABASE ACCESSION NUMBER: NCBI ACCESSION: NZ_RQUW01000044.1
  ref <309>: DATABASE ENTRY DATE: 2019-04-01
  ref <313>: RELEVANT RESIDUES IN SEQ ID NO: (1)..(1489)
tcaacttgagagtttgatcctggctcagaacgaacgctggcggcaggcttaacacatgcaagtcgagcgccccgcaaggggagcggcagacgggtgagtaacgcgtgggaatctaccatttgctacggaacaacagttggaaacgactgctaataccgtatgtgccctttgggggaaagatttatcggcaaatgatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcattgagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagaatgccgcggtgaatacgttcccgggccttgtacacaccgcccgtcacaccatgggagttggttttacccgaaggcgctgtgctaaccgcaaggaggcaggcgaccacggtagggtcagcgactggggtgaagtcgtaacaaggtagccgtaggggaacctgcggctggatcacctcctttctaag

SEQ ID NO: 2237 - DNA, 1533 bp, Brumimicrobium aurantiacum
  ref <308>: DATABASE ACCESSION NUMBER: NCBI ACCESSION: NZ_QURB01000016.1
  ref <309>: DATABASE ENTRY DATE: 2019-04-01
  ref <313>: RELEVANT RESIDUES IN SEQ ID NO: (1)..(1533)
ttttacaacggagagtttgatcctggctcaggatgaacgctagcggcaggcctaacacatgcaagtcgaggggtaacgagaagtgcttgcacttcggcgacgaccggcgcacgggtgagtaacgcgtatgcaacctgccttctacagggggatagcccggagaaatccggattaataccccatacgattgatttaacacaagttagatcaaagaaagcttcggcggtagaagatgggcatgcgtcctattagttagttggtaaggtaacggcttaccaagacagcgataggtagggggcctgagagggtgaacccccacactggtactgagacacggaccagactcctacgggaggcagcagtgaggaatattggtcaatggaggcaactctgaaccagccatgccgcgtgcaggaagaatgccctatgggttgtaaactgcttttatttaggaagaaaccccagtacgtgtactgggctgacggtactaaacgaataaggaccggctaactccgtgccagcagccgcggtaatacggagggtccaagcgttatccggaatcattgggtttaaagggtccgcaggcgggctattaagtcagtggtgaaatctcttggcttaaccaagaaattgccattgaaactattagtcttgaattcggtcgaagtgggcggaatgtgtcatgtagcggtgaaatgcatagatatgacacagaacaccgatagcgaaggcagctcactaggcctgaattgacgctcagggacgaaagcgtggggagcgaacaggattagataccctggtagtccacgccgtaaacgatcattactcgatatcagcgatatacagttggtgtctaagcgaaagtgataagtaatgcacctggggagtacgatcgcaaggttgaaactcaaaggaattgacgggggcccgcacaagcggtggagcatgtggtttaattcgatgatacgcgaggaaccttaccagggcttaaatgcataatgacaggactggaaacagttttttcttcggacattttgcaaggtgctgcatggctgtcgtcagctcgtgccgtgaggtgttgggttaagtcccgcaacgagcgcaacccctatctttagttgctagcaggtaatgctgaggactctagagaaactgccagcgcaagctgagaggaaggcggggacgacgtcaagtcatcacggcccttacgtcctgggctacacacgtgctacaatggtcggtacagagggcagctaccaagtgattggatgcgaatctcgaaagccgatctcagttcggattggagtctgcaactcgactccatgaagctggaatcgctagtaatcgcgcatcagccatggcgcggtgaatacgttcccgggccttgtacacaccgcccgtcaagccatggaagctgggggtacctgaagtcggtaaccgcaaggagctgcctagggtaaaaccggtaactggggctaagtcgtaacaaggtagccgtaccggaaggtgcggctggaacatctcctttctaga

SEQ ID NO: 2238 - DNA, 1529 bp, Brumimicrobium glaciale
  ref <308>: DATABASE ACCESSION NUMBER: NCBI ACCESSION: NZ_SETE01000006.1
  ref <309>: DATABASE ENTRY DATE: 2019-04-01
  ref <313>: RELEVANT RESIDUES IN SEQ ID NO: (1)..(1529)
ttttacaacggagagtttgatcctggctcaggatgaacgctagcggcaggcctaacacatgcaagtcgaggggtaacattgagcttgctcagatgacgaccggcgcacgggtgagtaacgcgtatgcaacctaccttctacagggggatagcccggagaaatccggattaataccccatacgattattgagacacaagtttcagtaaagaaagcttcggcggtagaagatgggcatgcgttctattagttagttggtaaggtaacggcttaccaagaccgcgatagatagggggcctgagagggtgaccccccacactggtactgagacacggaccagactcctacgggaggcagcagtgaggaatattggacaatggaggcaactctgatccagccatgccgcgtgcaggaagaatgccctatgggttgtaaactgcttttatttaggaagaatcgcaagtacgtgtacttgtttgacggtactaaacgaataaggaccggctaactccgtgccagcagccgcggtaatacggagggtccaagcgttatccggaatcattgggtttaaagggtccgcaggcgggctattaagtcagtggtgaaatctcttggcttaaccaagaaattgccattgaaactactagtcttgaattcggtcgaagtgggcggaatgtgtcatgtagcggtgaaatgcatagatatgacacagaacaccgatagcgaaggcagctcactaggcctgaattgacgctcagggacgaaagcgtggggagcgaacaggattagataccctggtagtccacgccgtaaacgatcattactcgatatcagcgatatacagttggtgtctaagcgaaagtgataagtaatgcacctggggagtacgatcgcaaggttgaaactcaaaggaattgacgggggcccgcacaagcggtggagcatgtggtttaattcgatgatacgcgaggaaccttaccagggcttaaatgcattatgacaggggtggaaacacctttttcttcggacattttgcaaggtgctgcatggctgtcgtcagctcgtgccgtgaggtgttgggttaagtcccgcaacgagcgcaacccctatctttagttgctagcaggtaatgctgaggactctagagaaactgccagcgcaagctgtgaggaaggcggggacgacgtcaagtcatcacggcccttacgtcctgggctacacacgtgctacaatggtcggtacagagggcagctaccacgtgagtggatgcgaatctcgaaagccgatctcagttcggattggagtctgcaactcgactccatgaagctggaatcgctagtaatcgcgcatcagccatggcgcggtgaatacgttcccgggccttgtacacaccgcccgtcaagccatggaagctgggggtacctgaagtcggtaaccgcaaggagctgcctagggtaaatctggtaactggggctaagtcgtaacaaggtagccgtaccggaaggtgcggctggaacatctcctttctaga

SEQ ID NO: 2239 - DNA, 1528 bp, Brumimicrobium mesophilum
  ref <308>: DATABASE ACCESSION NUMBER: NCBI ACCESSION: NZ_PVSS01000029.1
  ref <309>: DATABASE ENTRY DATE: 2019-04-01
  ref <313>: RELEVANT RESIDUES IN SEQ ID NO: (1)..(1528)
tacaacggagagtttgatcctggctcaggatgaacgctagcggcaggcctaacacatgcaagtcgaggggtaacattggtgcttgcatcagatgacgaccggcgcacgggtgagtaacgcgtatgcaacctaccttctacagggggatagcccggagaaatccggattaataccccatacgatccttacaacacaagttgttaggaggaaagcttcggcggtagaagatgggcatgcgttctattagttagttggtagggtaacggcttaccaagacagcgatagatagggggcctgagagggtgaacccccacactggtactgagacacggaccagactcctacgggaggcagcagtgaggaatattggacaatgggcgcaagcctgatccagccatgccgcgtgcaggaagaatgccctatgggttgtaaactgcttttatttaggaagaaaccccccaacgtgttgggggctgacggtactaaacgaataaggaccggctaactccgtgccagcagccgcggtaatacggagggtccaagcgttatccggaatcattgggtttaaagggtccgcaggcgggcttttaagtcagtggtgaaatctcttggcttaaccaagaaattgccattgaaactataagtcttgaattcggtcgaagtgggcggaatgtgtcatgtagcggtgaaatgcatagatatgacacagaacaccgatagcgaaggcagctcactaggcctgaattgacgctcagggacgaaagcgtggggagcgaacaggattagataccctggtagtccacgccgtaaacgatcattactcgatatcagcgatatacagttggtgtctaagcgaaagtgataagtaatgcacctggggagtacgatcgcaaggttgaaactcaaaggaattgacgggggcccgcacaagcggtggagcatgtggtttaattcgatgatacgcgaggaaccttaccagggcttaaatgcataatgacaggactggaaacagttttttcttcggacattttgcaaggtgctgcatggctgtcgtcagctcgtgccgtgaggtgttgggttaagtcccgcaacgagcgcaacccctatctttagttgctagcaggtaatgctgaggactctagagaaactgccagcgcaagctgagaggaaggcggggacgacgtcaagtcatcacggcccttacgtcctgggctacacacgtgctacaatggtcggtacagagggcagctaccaagtgattggatgcgaatctcgaaagccgatctcagttcggattggagtctgcaactcgactccatgaagctggaatcgctagtaatcgcgcatcagccatggcgcggtgaatacgttcccgggccttgtacacaccgcccgtcaagccatggaagctgggggtacctgaagtcggtaaccgcaaggagctgcctagggtaaatctggtaactggggctaagtcgtaacaaggtagccgtaccggaaggtgcggctggaacatctcctttctaga

SEQ ID NO: 2240 - DNA, 1532 bp, Brumimicrobium salinarum
  ref <308>: DATABASE ACCESSION NUMBER: NCBI ACCESSION: NZ_PJNI01000003.1
  ref <309>: DATABASE ENTRY DATE: 2019-04-01
  ref <313>: RELEVANT RESIDUES IN SEQ ID NO: (1)..(1532)
tttttacaacggagagtttgatcctggctcaggatgaacgctagcggcaggcctaacacatgcaagtcgcggggtaacattggtgcttgcatcagatgacgaccggcgcacgggtgagtaacgcgtatgcaacctgccttctacaggaggatagcccggagaaatccggattaatactccatacgattgtcttcacacaagtgataacaaagaaagctacggcggtagaagatgggcatgcgtcctattagttagttggtaaggtaacggcttaccaagacagcgataggtagggggcctgagagggtgaacccccacactggtactgagacacggaccagactcctacgggaggcagcagtgaggaatattggacaatggaggcaactctgatccagccatgccgcgtgcaggaagaatgccctatgggttgtaaactgcttttatttaggaagaaaccccctaacgagttaggggctgacggtactaaacgaataaggaccggctaactccgtgccagcagccgcggtaatacggagggtccaagcgttatccggaatcattgggtttaaagggtccgcaggcggactattaagtcagtggtgaaatctcttggcttaaccaagaacttgccattgaaactattagtcttgaattcggtcgaagtgggcggaatgtgtcatgtagcggtgaaatgcatagatatgacacagaacaccgatagcgaaggcagctcactaggcctgaattgacgctcagggacgaaagcgtggggagcgaacaggattagataccctggtagtccacgccgtaaacgatcattactcgatatcagcgatatacagttggtgtctaagcgaaagtgataagtaatgcacctggggagtacgatcgcaaggttgaaactcaaaggaattgacgggggcccgcacaagcggtggagcatgtggtttaattcgatgatacgcgaggaaccttaccagggcttaaatgcataatgacaggagtggaaacacttttttcttcggacattttgcaaggtgctgcatggctgtcgtcagctcgtgccgtgaggtgttgggttaagtcccgcaacgagcgcaacccctatctttagttgctagcaggtaatgctgaggactctagagaaactgccagcgcaagctgagaggaaggcggggacgacgtcaagtcatcacggcccttacgtcctgggctacacacgtgctacaatggtcggtacagagggcagctaccaagtgattggatgctaatctcgaaagccgatctcagttcggattggagtctgcaactcgactccatgaagctggaatcgctagtaatcgcgcatcagccatggcgcggtgaatacgttcccgggccttgtacacaccgcccgtcaagccatggaagctgggggtacctgaagtcggtaaccgcaaggagctgcctagggtaaaactggtaactggggctaagtcgtaacaaggtagccgtaccggaaggtgcggctggaacatctcctttctaga

SEQ ID NO: 2241 - DNA, 1528 bp, Brumimicrobium sp. C305
  ref <308>: DATABASE ACCESSION NUMBER: NCBI ACCESSION: NZ_QFRJ01000026.1
  ref <309>: DATABASE ENTRY DATE: 2019-04-01
  ref <313>: RELEVANT RESIDUES IN SEQ ID NO: (1)..(1528)
tacaacggagagtttgatcctggctcaggatgaacgctagcggcaggcctaacacatgcaagtcgaggggtaacattggtgcttgcactagatgacgaccggcgcacgggtgagtaacgcgtatgcaacctaccttttactgggggatagcccggagaaatccggattaataccccatacgatccttgagacttaagttttagggaagaaagcttcggcggtattagatgggcatgcgttctattagttagttggtaaggtaacggcttaccaagaccgcgatagatagggggcctgagagggtgaacccccacactggtactgagacacggaccagactcctacgggaggcagcagtgaggaatattggacaatggaggcaactctgatccagccatgccgcgtgcaggaagaatgccctatgggttgtaaactgcttttatttaggaagaaaccccccaacgagttgggggctgacggtactaaacgaataaggaccggctaactccgtgccagcagccgcggtaatacggagggtccaagcgttatccggaatcattgggtttaaagggtccgcaggcgggctattaagtcagtggtgaaatctcttggcttaaccaagaaattgccattgaaactactagtcttgaattcggtcgaagtgggcggaatgtgtcatgtagcggtgaaatgcatagatatgacacagaacaccgatagcgaaggcagctcactaggcctgaattgacgctcagggacgaaagcgtggggagcgaacaggattagataccctggtagtccacgccgtaaacgatcattactcgatatcagcgatatacagttggtgtctaagcgaaagtgataagtaatgcacctggggagtacgatcgcaaggttgaaactcaaaggaattgacgggggcccgcacaagcggtggagcatgtggtttaattcgatgatacgcgaggaaccttaccagggcttaaatgcataatgacaggagtggaaacacttttttcttcggacattttgcaaggtgctgcatggctgtcgtcagctcgtgccgtgaggtgttgggttaagtcccgcaacgagcgcaacccctatctttagttgctagcaggtaatgctgaggactctagagaaactgccagcgcaagctgagaggaaggcggggacgacgtcaagtcatcacggcccttacgtcctgggctacacacgtgctacaatggtcggtacagagggcagctaccaagtgattggatgcgaatctcgaaagccgatctcagttcggattggagtctgcaactcgactccatgaagctggaatcgctagtaatcgcgcatcagccatggcgcggtgaatacgttcccgggccttgtacacaccgcccgtcaagccatggaagctgggggtacctgaagtcggtaaccgcaaggagctgcctagggtaaatctggtaactggggctaagtcgtaacaaggtagccgtaccggaaggtgcggctggaacatctcctttctaga

SEQ ID NO: 2242 - DNA, 1552 bp, Budvicia aquatica
  ref <308>: DATABASE ACCESSION NUMBER: NCBI ACCESSION: NZ_PDDX01000001.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggcagcggaaagtagcttgctactttgccggcgagcggcggacgggtgagtaatgtctggggatctgcctgatggagggggataactactggaaacggtagctaataccgcgtaacgtcgcaagaccaaagcgggggaccttcgggcctcgcgccatcagatgaacccagatgggattagctagtaggtggggtaatggctcacctaggcgacgatctctaactggtctgagaggatgaccagtcacactgggactgagacacggcccagactcctacgggaggcagcagtggggaatattgcacaatgggcgcaagcctgatgcagccatgccgcgtgtgtgaagaaggccttcgggttgtaaagcactttcagcgaggaggaaggcgttgcagttaataactgcaacgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccatgtgtagcggtgaaatgcgtagagatgtggaggaataccggtggcgaaggcggccccctggacaaagactgacgctcaggtgcgaaagcgtggggagcaaacaggattagataccctggtagtccacgctgtaaacgatgtcgatttggaggttgtgggcatgacccgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcacataatggtgggaactcaaaggagactgccggtgataaaccggaggaaggtggggatgacgtcaagtcatcatggcccttacgagtagggctacacacgtgctacaatggcgcatacaaagtgaagcgagctcgcgagagtaagcggaccacataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 2243 - DNA, 1539 bp, Burkholderia ambifaria
  ref <308>: DATABASE ACCESSION NUMBER: NCBI ACCESSION: NZ_UZVX01000004.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatacagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2244 - DNA, 1539 bp, Burkholderia anthina
  ref <308>: DATABASE ACCESSION NUMBER: NCBI ACCESSION: NZ_UZVW01000004.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttgaccctaatacggtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2245 - DNA, 1539 bp, Burkholderia cepacia
  ref <308>: DATABASE ACCESSION NUMBER: NCBI ACCESSION: NZ_UARD01000012.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccctggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2246 - DNA, 1539 bp, Burkholderia contaminans
  ref <308>: DATABASE ACCESSION NUMBER: NCBI ACCESSION: NZ_QTQZ01000070.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2247 - DNA, 1539 bp, Burkholderia dolosa
  ref <308>: DATABASE ACCESSION NUMBER: NCBI ACCESSION: NZ_CP033838.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaaccctggctctaatacagccgggggatgacggtaccggaagaataagcaccggctaactacgtgccagcagccgcggtaatacgtagggtgcgagcgttaatcggaattactgggcgtaaagcgtgcgcaggcggttcgctaagaccgatgtgaaatccccgggctcaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagattcgggagtgctcgaaagagaaccggcacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2248 - DNA, 1540 bp, Burkholderia gladioli
  ref <308>: DATABASE ACCESSION NUMBER: NCBI ACCESSION: NZ_UZVS01000002.1
  ref <309>: DATABASE ENTRY DATE: 2019-04-01
  ref <313>: RELEVANT RESIDUES IN SEQ ID NO: (1)..(1540)
attgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatccgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2249 - DNA, 1536 bp, Burkholderia glumae
  ref <308>: DATABASE ACCESSION NUMBER: NCBI ACCESSION: NZ_QTQU01000080.1
  ref <309>: DATABASE ENTRY DATE: 2019-04-01
  ref <313>: RELEVANT RESIDUES IN SEQ ID NO: (1)..(1536)
aactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2250 - DNA, 1537 bp, Burkholderia lata
  ref <308>: DATABASE ACCESSION NUMBER: NCBI ACCESSION: NZ_CP024943.1
  ref <309>: DATABASE ENTRY DATE: 2019-04-01
  ref <313>: RELEVANT RESIDUES IN SEQ ID NO: (1)..(1537)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttgaccctaatacggtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagagggggtagaattccacgtgtagcagtgaaatgcgtagagatgtggaggaataccgatggcgaaggcagcccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2251 - DNA, 1529 bp, Burkholderia mallei
  ref <308>: DATABASE ACCESSION NUMBER: NCBI ACCESSION: NZ_UFUG01000002.1
  ref <309>: DATABASE ENTRY DATE: 2019-04-01
  ref <313>: RELEVANT RESIDUES IN SEQ ID NO: (1)..(1529)
aagagtttgatcctggctcagattgaacgctggcggcatgccttacacatgcaagtcgaacggcagcacgggcttcggcctggtggcgagtggtgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcattctggctaatacccggagtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagcccgatgagagttgggcgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2252 - DNA, 1539 bp, Burkholderia metallica
  ref <308>: DATABASE ACCESSION NUMBER: NCBI ACCESSION: NZ_MULQ01000115.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttgattctaatacagtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2253 - DNA, 1539 bp, Burkholderia novacaledonica
  ref <308>: DATABASE ACCESSION NUMBER: NCBI ACCESSION: NZ_OGTP01000052.1
  ref <309>: DATABASE ENTRY DATE: 2019-04-01
  ref <313>: RELEVANT RESIDUES IN SEQ ID NO: (1)..(1539)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatcttcggacctcgcgctgcaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaaccaacgccctaatatggtggtgggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggcttggagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggcggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2254 - DNA, 1539 bp, Burkholderia oklahomensis
  ref <308>: DATABASE ACCESSION NUMBER: NCBI ACCESSION: NZ_UWYU01000002.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcctaccgactaatactgggtggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2255 - DNA, 1529 bp, Burkholderia pseudomallei
  ref <308>: DATABASE ACCESSION NUMBER: NCBI ACCESSION: NZ_UVSW01000002.1
  ref <309>: DATABASE ENTRY DATE: 2019-04-01
  ref <313>: RELEVANT RESIDUES IN SEQ ID NO: (1)..(1529)
aagagtttgatcctggctcagattgaacgctggcggcatgccttacacatgcaagtcgaacggcagcacgggcttcggcctggtggcgagtggcgaacgggtgagtaatacatcggaacatgtcctgtagtgggggatagcccggcgaaagccggattaataccgcatacgatctgaggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcattctggctaatacccggagtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagcccgatgagagttgggcgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2256 - DNA, 1539 bp, Burkholderia puraquae
  ref <308>: DATABASE ACCESSION NUMBER: NCBI ACCESSION: NZ_NBYX01000050.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggygggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2257 - DNA, 1539 bp, Burkholderia reimsis
  ref <308>: DATABASE ACCESSION NUMBER: NCBI ACCESSION: NZ_QMFZ01000103.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2258 - DNA, 1352 bp, Burkholderia seminalis
  ref <308>: DATABASE ACCESSION NUMBER: NCBI ACCESSION: NZ_QTQR01000064.1
  ref <309>: DATABASE ENTRY DATE: 2019-04-01
  ref <313>: RELEVANT RESIDUES IN SEQ ID NO: (1)..(1352)
ggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2259 - DNA, 1529 bp, Burkholderia sp. 117; identical to SEQ ID NO: 2255
  ref <308>: DATABASE ACCESSION NUMBER: NCBI ACCESSION: NZ_NMVE01000068.1
  ref <309>: DATABASE ENTRY DATE: 2019-04-01
  ref <313>: RELEVANT RESIDUES IN SEQ ID NO: (1)..(1529)

SEQ ID NO: 2260 - DNA, 1529 bp, Burkholderia sp. 129; identical to SEQ ID NO: 2255
  ref <308>: DATABASE ACCESSION NUMBER: NCBI ACCESSION: NZ_NMVF01000053.1
  ref <309>: DATABASE ENTRY DATE: 2019-04-01
  ref <313>: RELEVANT RESIDUES IN SEQ ID NO: (1)..(1529)

SEQ ID NO: 2261 - DNA, 1529 bp, Burkholderia sp. 136 2017; identical to SEQ ID NO: 2255
  ref <308>: DATABASE ACCESSION NUMBER: NCBI ACCESSION: NZ_NMVG01000060.1
  ref <309>: DATABASE ENTRY DATE: 2019-04-01
  ref <313>: RELEVANT RESIDUES IN SEQ ID NO: (1)..(1529)

SEQ ID NO: 2262 - DNA, 1529 bp, Burkholderia sp. 137; identical to SEQ ID NO: 2255
  ref <308>: DATABASE ACCESSION NUMBER: NCBI ACCESSION: NZ_NMVH01000060.1
  ref <309>: DATABASE ENTRY DATE: 2019-04-01
  ref <313>: RELEVANT RESIDUES IN SEQ ID NO: (1)..(1529)

SEQ ID NO: 2263 - DNA, 1539 bp, Burkholderia sp. BDU6
  ref <308>: DATABASE ACCESSION NUMBER: NCBI ACCESSION: NZ_CP013386.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctgtggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcattctggctaataaccggggtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgccgagaggcgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2264 - DNA, 1539 bp, Burkholderia sp. BDU8
  ref <308>: DATABASE ACCESSION NUMBER: NCBI ACCESSION: NZ_CP013389.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctgtggatgaaagcgggggaccttcgggcctcgcgctatagggttggccgatggctgattagctagttggtagggtaaaggcctaccaaggcgacgatcagtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcatcctggctaataaccggggtggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2265 - DNA, 1539 bp, Burkholderia sp. Bp8963
  ref <308>: DATABASE ACCESSION NUMBER: NCBI ACCESSION: NZ_QTQP01000132.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccctggtcctaatacgatcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2266 - DNA, 1539 bp, Burkholderia sp. Bp8977
  ref <308>: DATABASE ACCESSION NUMBER: NCBI ACCESSION: NZ_QTQO01000090.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaattccgctgagaggtggaagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2267 - DNA, 1005 bp, Burkholderia sp. Bp8984
  ref <308>: DATABASE ACCESSION NUMBER: NCBI ACCESSION: NZ_QTQN01000045.1
  ref <309>: DATABASE ENTRY DATE: 2019-04-01
  ref <313>: RELEVANT RESIDUES IN SEQ ID NO: (1)..(1005)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcc

SEQ ID NO: 2268 - DNA, 1342 bp, Burkholderia sp. Bp8986
  ref <308>: DATABASE ACCESSION NUMBER: NCBI ACCESSION: NZ_QTQM01000153.1
  ref <309>: DATABASE ENTRY DATE: 2019-04-01
  ref <313>: RELEVANT RESIDUES IN SEQ ID NO: (1)..(1342)
gggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2269 - DNA, 1539 bp, Burkholderia sp. Bp8989
  ref <308>: DATABASE ACCESSION NUMBER: NCBI ACCESSION: NZ_QTQL01000090.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaattctgctgagaggtggaagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2270 - DNA, 1539 bp, Burkholderia sp. Bp8990
  ref <308>: DATABASE ACCESSION NUMBER: NCBI ACCESSION: NZ_QTQK01000074.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2271 - DNA, 1539 bp, Burkholderia sp. Bp8991; identical to SEQ ID NO: 2266
  ref <308>: DATABASE ACCESSION NUMBER: NCBI ACCESSION: NZ_QTQJ01000072.1
  ref <309>: DATABASE ENTRY DATE: 2019-04-01
  ref <313>: RELEVANT RESIDUES IN SEQ ID NO: (1)..(1539)

SEQ ID NO: 2272 - DNA, 1539 bp, Burkholderia sp. Bp8992
  ref <308>: DATABASE ACCESSION NUMBER: NCBI ACCESSION: NZ_QTQI01000060.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2273 - DNA, 1539 bp, Burkholderia sp. Bp8994
  ref <308>: DATABASE ACCESSION NUMBER: NCBI ACCESSION: NZ_QTQH01000046.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2274 - DNA, 1539 bp, Burkholderia sp. Bp8995; identical to SEQ ID NO: 2273
  ref <308>: DATABASE ACCESSION NUMBER: NCBI ACCESSION: NZ_QTQG01000084.1
  ref <309>: DATABASE ENTRY DATE: 2019-04-01
  ref <313>: RELEVANT RESIDUES IN SEQ ID NO: (1)..(1539)

SEQ ID NO: 2275 - DNA, 1539 bp, Burkholderia sp. Bp8998
  ref <308>: DATABASE ACCESSION NUMBER: NCBI ACCESSION: NZ_QTQF01000109.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatatggccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2276 - DNA, 1539 bp, Burkholderia sp. Bp9002
  ref <308>: DATABASE ACCESSION NUMBER: NCBI ACCESSION: NZ_QTQE01000061.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatatgaccgggggatgacggtaccggaagaataagcaccggctaactacgtgccagcagccgcggtaatacgtagggtgcgagcgttaatcggaattactgggcgtaaagcgtgcgcaggcggttcgctaagaccgatgtgaaatccccgggctcaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgccgagaggcgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2277 - DNA, 1539 bp, Burkholderia sp. Bp9004
  ref <308>: DATABASE ACCESSION NUMBER: NCBI ACCESSION: NZ_QTQD01000070.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatatagccgggggatgacggtaccggaagaataagcaccggctaactacgtgccagcagccgcggtaatacgtagggtgcaagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2278 - DNA, 1539 bp, Burkholderia sp. Bp9010; identical to SEQ ID NO: 2266
  ref <308>: DATABASE ACCESSION NUMBER: NCBI ACCESSION: NZ_QTQC01000081.1
  ref <309>: DATABASE ENTRY DATE: 2019-04-01
  ref <313>: RELEVANT RESIDUES IN SEQ ID NO: (1)..(1539)

SEQ ID NO: 2279 - DNA, 1539 bp, Burkholderia sp. Bp9011; identical to SEQ ID NO: 2266
  ref <308>: DATABASE ACCESSION NUMBER: NCBI ACCESSION: NZ_QTQB01000092.1
  ref <309>: DATABASE ENTRY DATE: 2019-04-01
  ref <313>: RELEVANT RESIDUES IN SEQ ID NO: (1)..(1539)

SEQ ID NO: 2280 - DNA, 1539 bp, Burkholderia sp. Bp9012
  ref <308>: DATABASE ACCESSION NUMBER: NCBI ACCESSION: NZ_QTQA01000069.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatatagccgggggatgacggtaccggaagaataagcaccggctaactacgtgccagcagccgcggtaatacgtagggtgcaagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2281 - DNA, 1539 bp, Burkholderia sp. Bp9015
  ref <308>: DATABASE ACCESSION NUMBER: NCBI ACCESSION: NZ_QTPZ01000084.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttgattctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2282 - DNA, 1539 bp, Burkholderia sp. Bp9016
  ref <308>: DATABASE ACCESSION NUMBER: NCBI ACCESSION: NZ_QTPY01000071.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2283 - DNA, 1539 bp, Burkholderia sp. Bp9017; identical to SEQ ID NO: 2282
  ref <308>: DATABASE ACCESSION NUMBER: NCBI ACCESSION: NZ_QTPX01000085.1
  ref <309>: DATABASE ENTRY DATE: 2019-04-01
  ref <313>: RELEVANT RESIDUES IN SEQ ID NO: (1)..(1539)

SEQ ID NO: 2284 - DNA, 1539 bp, Burkholderia sp. Bp9031
  ref <308>: DATABASE ACCESSION NUMBER: NCBI ACCESSION: NZ_QTPW01000082.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatatagccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2285 - DNA, 1539 bp, Burkholderia sp. Bp9090; identical to SEQ ID NO: 2273
  ref <308>: DATABASE ACCESSION NUMBER: NCBI ACCESSION: NZ_QTPV01000096.1
  ref <309>: DATABASE ENTRY DATE: 2019-04-01
  ref <313>: RELEVANT RESIDUES IN SEQ ID NO: (1)..(1539)

SEQ ID NO: 2286 - DNA, 1539 bp, Burkholderia sp. Bp9099; identical to SEQ ID NO: 2270
  ref <308>: DATABASE ACCESSION NUMBER: NCBI ACCESSION: NZ_QTPU01000082.1
  ref <309>: DATABASE ENTRY DATE: 2019-04-01
  ref <313>: RELEVANT RESIDUES IN SEQ ID NO: (1)..(1539)

SEQ ID NO: 2287 - DNA, 1539 bp, Burkholderia sp. Bp9125
  ref <308>: DATABASE ACCESSION NUMBER: NCBI ACCESSION: NZ_QTPT01000066.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatatggccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgccgagaggcgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2288 - DNA, 1539 bp, Burkholderia sp. Bp9126
  ref <308>: DATABASE ACCESSION NUMBER: NCBI ACCESSION: NZ_QTPS01000135.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccctggtcctaatacgaccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgccgagaggcgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2289 - DNA, 1539 bp, Burkholderia sp. Bp9131; identical to SEQ ID NO: 2281
  ref <308>: DATABASE ACCESSION NUMBER: NCBI ACCESSION: NZ_QTPR01000082.1
  ref <309>: DATABASE ENTRY DATE: 2019-04-01
  ref <313>: RELEVANT RESIDUES IN SEQ ID NO: (1)..(1539)

SEQ ID NO: 2290 - DNA, 1539 bp, Burkholderia sp. Bp9140
  ref <308>: DATABASE ACCESSION NUMBER: NCBI ACCESSION: NZ_QTPQ01000098.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatatggccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2291 - DNA, 1539 bp, Burkholderia sp. Bp9142
  ref <308>: DATABASE ACCESSION NUMBER: NCBI ACCESSION: NZ_QTPP01000084.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatccatggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatatggccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2292 - DNA, 1539 bp, Burkholderia sp. Bp9143
  ref <308>: DATABASE ACCESSION NUMBER: NCBI ACCESSION: NZ_QTPO01000125.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaattcttggtcctaatatggccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2293 - DNA, 1538 bp, Burkholderia sp. D7
  ref <308>: DATABASE ACCESSION NUMBER: NCBI ACCESSION: NZ_OCSX01000001.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggagtaatcctggtggcgagtggcgaacgggtgagtaatacatcggaacgtgtcctgtagtgggggatagcccggcgaaagccggattaataccgcatacgatctacggaagaaagcgggggaccgaaaggcctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacttctgccctaatacggtgggaggatgacggtaccggaagaataagcaccggctaactacgtgccagcagccgcggtaatacgtagggtgcgagcgttaatcggaattactgggcgtaaagcgtgcgcaggcggttcgttaagacagatgtgaaatccccgggcttaacctgggaactgcatttgtgactggcgagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggctgccaacccgtgagggggagctaatcccagaaaaccgatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2294 - DNA, 1015 bp, Burkholderia sp. HAN2018
  ref <308>: DATABASE ACCESSION NUMBER: NCBI ACCESSION: NZ_QXTL01000016.1
  ref <309>: DATABASE ENTRY DATE: 2019-04-01
  ref <313>: RELEVANT RESIDUES IN SEQ ID NO: (1)..(1015)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagagg

SEQ ID NO: 2295 - DNA, 1539 bp, Burkholderia sp. JP2-270
  ref <308>: DATABASE ACCESSION NUMBER: NCBI ACCESSION: NZ_CP029824.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2296 - DNA, 1539 bp, Burkholderia sp. LA-2-3-30-S1-D2
  ref <308>: DATABASE ACCESSION NUMBER: NCBI ACCESSION: NZ_CP013384.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatatagccgggggatgacggtaccggaagaataagcaccggctaactacgtgccagcagccgcggtaatacgtagggtgcaagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2297 - DNA, 1539 bp, Burkholderia sp. MSMB0856
  ref <308>: DATABASE ACCESSION NUMBER: NCBI ACCESSION: NZ_CP013427.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatatggccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2298 - DNA, 1539 bp, Burkholderia sp. Nafp2 4-1b
  ref <308>: DATABASE ACCESSION NUMBER: NCBI ACCESSION: NZ_ML058648.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatatagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2299 - DNA, 1537 bp, Burkholderia sp. OK233
  ref <308>: DATABASE ACCESSION NUMBER: NCBI ACCESSION: NZ_OCSR01000002.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctacggaggaaagggggggatcttaggacctcccgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacctctgccctaatatggcggggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggtcggggtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2300 - DNA, 1538 bp, Burkholderia sp. OK806
  ref <308>: DATABASE ACCESSION NUMBER: NCBI ACCESSION: NZ_OCSU01000002.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctggagtgggggatagcccggcgaaagccggattaataccgcatacgctctacggaggaaagggggggatcgcaagacctctcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacttcctggttaatacctggggaggatgacggtaccggaagaataagcaccggctaactacgtgccagcagccgcggtaatacgtagggtgcgagcgttaatcggaattactgggcgtaaagcgtgcgcaggcggtctgttaagacagatgtgaaatccccgggcttaacctgggaactgcatttgtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgctaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2301 - DNA, 1538 bp, Burkholderia sp. PAMC 26561
  ref <308>: DATABASE ACCESSION NUMBER: NCBI ACCESSION: NZ_CP014306.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatcgcaagacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacctttgcactaatactgtgaggggatgacggtaccggaagaataagcaccggctaactacgtgccagcagccgcggtaatacgtagggtgcgagcgttaatcggaattactgggcgtaaagcgtgcgcaggcggttcgttaagacagatgtgaaatccccgggcttaacctgggaactgcatttgtgactggcgagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggtcttcattgacttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaacctggctgaaaggctggggtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggctgccaacccgtgagggggagctaatcccagaaaaccgatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2302 - DNA, 1536 bp, Burkholderia sp. ST111
  ref <308>: DATABASE ACCESSION NUMBER: NCBI ACCESSION: NZ_LGIO01000123.1
  ref <309>: DATABASE ENTRY DATE: 2019-04-01
  ref <313>: RELEVANT RESIDUES IN SEQ ID NO: (1)..(1536)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgctctacggaggaaagggggggatctcaggacctcccgctacaggggcgccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaaacctccgccctaatatggtggggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaaccctgctgagaggtgggggtgcccgaaagggagccataacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2303 - DNA, 1534 bp, Burkholderia sp. YR290
  ref <308>: DATABASE ACCESSION NUMBER: NCBI ACCESSION: NZ_OCSV01000006.1
  ref <309>: DATABASE ENTRY DATE: 2019-04-01
  ref <313>: RELEVANT RESIDUES IN SEQ ID NO: (1)..(1534)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctggagtgggggatagcccggcgaaagccggattaataccgcatacgatctctggatgaaagcgggggaccgaaaggcctcgcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaatcgcttctctaatacagaggtgggatgacggtaccggaagaataagcaccggctaactacgtgccagcagccgcggtaatacgtagggtgcgagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgtcgggtcttcattgacttggtaacgaagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtacggaaccttgccgagaggtgagggtgcccgaaagggagccgtaacacaggtgctgcatggctgtcgtcagctcgtgtcgtgagatgttgggttaagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttc

SEQ ID NO: 2304 - DNA, 1538 bp, Burkholderia sp. yr520
  ref <308>: DATABASE ACCESSION NUMBER: NCBI ACCESSION: NZ_QLTP01000074.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacctcttggctaatacctaggggggatgacggtaccggaagaataagcaccggctaactacgtgccagcagccgcggtaatacgtagggtgcgagcgttaatcggaattactgggcgtaaagcgtgcgcaggcggtttgttaagacagatgtgaaatccccgggcttaacctgggaactgcatttgtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgctaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2305 - DNA, 1539 bp, Burkholderia stabilis
  ref <308>: DATABASE ACCESSION NUMBER: NCBI ACCESSION: NZ_LR025742.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggttctaatatagccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2306 - DNA, 1539 bp, Burkholderia stagnalis
  ref <308>: DATABASE ACCESSION NUMBER: NCBI ACCESSION: NZ_QTPN01000156.1
  ref <309>: DATABASE ENTRY DATE: 2019-04-01
  ref <313>: RELEVANT RESIDUES IN SEQ ID NO: (1)..(1539)
ttgaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggtcctaatatggccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2307 - DNA, 1538 bp, Burkholderia thailandensis
  ref <308>: DATABASE ACCESSION NUMBER: NCBI ACCESSION: NZ_CP022217.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcgcgggcttcggcctggcggcgagtggcgaacgggtgagtaatacatcggaacatgtcctgtagtgggggatagcccggcgaaagccggattaataccgcatacgatctgtggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaatcatcctggctaataaccggggtggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2308 - DNA, 1537 bp, Burkholderia ubonensis
  ref <308>: DATABASE ACCESSION NUMBER: NCBI ACCESSION: NZ_QTOC01000056.1
  ref <309>: DATABASE ENTRY DATE: 2019-04-01
  ref <313>: RELEVANT RESIDUES IN SEQ ID NO: (1)..(1537)
ttgaactgaagagtttgatcctggctcagattgaacgctggcggcatgccttacacatgcaagtcgaacggcagcacgggcttcggcctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatccttggccctaatatggccgggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagattcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2309 - DNA, 1539 bp, Burkholderia vietnamiensis
  ref <308>: DATABASE ACCESSION NUMBER: NCBI ACCESSION: NZ_UZVT01000002.1
  ref <309>: DATABASE ENTRY DATE: 2019-04-01
  ref <313>: RELEVANT RESIDUES IN SEQ ID NO: (1)..(1539)
ttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtgggggatagcccggcgaaagccggattaataccgcatacgatctagggatgaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagccgggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaagagattcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccag

SEQ ID NO: 2310 - DNA, 1540 bp, Burkholderiales bacterium CNM695-12
  ref <308>: DATABASE ACCESSION NUMBER: NCBI ACCESSION: NZ_PQSP01000014.1
  ref <309>: DATABASE ENTRY DATE: 2019-04-01
  ref <313>: RELEVANT RESIDUES IN SEQ ID NO: (1)..(1540)
gattaaactgaagagtttgatcctggctcagattgaacgctggcggcatgctttacacatgcaagtcgaacggcagcacgggtgcttgcacctggtggcgagtggcgaacgggtgagtaatacatcggaacgtgcccagtagtgggggatagctcggcgaaagccggattaataccgcataatacctatgggagaaagcaggggaccttcgggccttgtgctattggagcggccgatgacagattaggtagttggtggggtaaaggcctaccaagcccgcgatctgtagctggtctgagaggatgatcagccacactgggactgagacacggcccagactcctacgggaggcagcagtggggaattttggacaatgggggcaaccctgatccagccatgccgcgtgcaggaagaaggccttcgggttgtaaactgcttttgtcagggaagaaatcctgcttgataataccttgcggggatgacggtacctgaagaataagcaccggctaactacgtgccagcagccgcggtaatacgtagggtgcgagcgttaatcggaattactgggcgtaaagcgtgcgcaggcggtgttgtaagaccgatgtgaaatccccgggcttaacctgggaactgcattggtgactgcaatgcttgagtacggtagaggggggtggaattttgcgtgtagcagtgaaatgcgtagatatgcaaaggaacaccgatggcgaaggcagccccctggacctgtactgacgctcatgcacgaaagcgtggggagcaaacaggattagataccctggtagtccacgccctaaacgatgtcaactagttgttggagagtttaatcttcagtaacgaagccaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgtcaggaatccttcagagatgagggagtgctcgcaagagaacctgaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggctacacacgtcatacaatggctggtacaaagggctgccaacccgcgagggggagccaatcctataaaaccagtcgtagtccggattgcactctgcaactcgagtgcatgaagtcggaatcgctagtaatcgtggatcagcatgtcacggtgaatacgttcccgggtcttgtacacaccgcccgtcacaccatgggagcgggttttgccagaagtagttagcctaaccgcaaggagggcgattaccacggcagggttcgtgactggggtgaagtcgtaacaaggtagccgtaccggaaggtgcggctggatcacctcctttctg

SEQ ID NO: 2311 - DNA, 1552 bp, Buttiauxella agrestis
  ref <308>: DATABASE ACCESSION NUMBER: NCBI ACCESSION: NZ_UIGI01000001.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggtagcacaagagagcttgctctctgggtgacgagcggcggacgggtgagtaatgtctgggaaactgcctgatggagggggataactactggaaacggtagctaataccgcataacgtcttcggaccaaagagggggaccttcgggcctcttgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaataga

SEQ ID NO: 2312 - DNA, 1550 bp, Buttiauxella izardii
  ref <308>: DATABASE ACCESSION NUMBER: NCBI ACCESSION: NZ_QZWH01000019.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggtagcacagggagcttgctcctgggtgacgagcggcggacgggtgagtaatgtctgggaaactgcctgatggagggggataactactggaaacggtagctaataccgcataacgtcttcggaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaaga

SEQ ID NO: 2313 - DNA, 1552 bp, Buttiauxella sp. 3AFRM03
  ref <308>: DATABASE ACCESSION NUMBER: NCBI ACCESSION: NZ_CP033076.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggtagcacaggagagcttgctctctgggtgacgagcggcggacgggtgagtaatgtctgggaaactgcctgatggagggggataactactggaaacggtagctaataccgcataacgtcttcggaccaaagagggggaccttcgggcctcttgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaattcggcagagatgccttagtgccttcgggaactgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaataga

SEQ ID NO: 2314 - DNA, 1550 bp, Buttiauxella warmboldiae
  ref <308>: DATABASE ACCESSION NUMBER: NCBI ACCESSION: NZ_RPOH01000027.1
  ref <309>: DATABASE ENTRY DATE: 2019-04-01
  ref <313>: RELEVANT RESIDUES IN SEQ ID NO: (1)..(1550)
ttaattgaagagtttgatcatggctcagattgaacgctggcggcaggcctaacacatgcaagtcgagcggtagcacagggagcttgctcctgggtgacgagcggcggacgggtgagtaatgtctgggaaactgcctgatggagggggataactactggaaacggtagctaataccgcataacgtcttcggaccaaagagggggaccttcgggcctcttgccatcagatgtgcccagatgggattagctagcaggtgaggtaatggctcacctgggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaaga

SEQ ID NO: 2315 - DNA, 1530 bp, Butyricicoccus porcorum
  ref <308>: DATABASE ACCESSION NUMBER: NCBI ACCESSION: NZ_NHOC01000001.1
  ref <309>: DATABASE ENTRY DATE: 2019-04-01
  ref <313>: RELEVANT RESIDUES IN SEQ ID NO: (1)..(1530)
tttttagagagtttgatcctggctcaggatgaacgctggcggcgtgcctaacacatgcaagtcgaacggagcactgagacttcggtttttgtgcttagtggcggacgggtgagtaacgcgtgagcaatctgcctttcagagggggataacgactggaaacggtcgctaataccgcataacgtattttgcaggcatctgcgagataccaaaggagcaatccgctgaaagatgagctcgcgtctgattagatagttggtgaggtaacggcccaccaagtcgacgatcagtagccggactgagaggttgaacggccacattgggactgagacacggcccagactcctacgggaggcagcagtggggaatattgcgcaatgggggaaaccctgacgcagcaacgccgcgtgatcgaagaaggtcttcggattgtaaagatcttttatcagggacgaagaaagtgacggtacctgatgaataagctccggctaactacgtgccagcagccgcggtaatacgtagggagcgagcgttatccggatttactgggtgtaaagggcgagtaggcgggctggtaagttggaagtgaaatgtcggggcttaaccccggaactgctttcaaaactgctggtcttgagtgatggagaggcaggcggaattcctagtgtagcggtgaaatgcgtagatattaggaggaacaccagtggcgaaggcggcctgctggacattaactgacgctgaggagcgaaagcgtggggagcaaacaggattagataccctggtagtccacgccgtaaacgatggatactaggtgtgggaggtattgaccccttccgtgccgcagttaacacaataagtatcccacctggggagtacgaccgcaaggttgaaactcaaaggaattgacgggggcccgcacaagcagtggagtatgtggtttaattcgaagcaacgcgaagaaccttacctggtcttgacatcccggtgaccggcatagagatatgcctttcccttcggggacagcggtgacaggtggtgcatggttgtcgtcagctcgtgtcgtgagatgttgggttaagtcccgcaacgagcgcaacccttattgttagttgatacatttagttgatcactctagcgagactgccgttgacaaaacggaggaaggtggggacgacgtcaaatcatcatgccccttatgaccagggctacacacgtactacaatggcagacatacagagggaagcaaagctgtgaggcagagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccggtaatgcccgaagtccgtagtctaaccgcaaggaggacgcggccgaaggcaggactggtaattagggtgaagtcgtaacaaggtagccgtatcggaaggtgcggctggatcacctcctttctaagga

SEQ ID NO: 2316 - DNA, 1271 bp, Butyricicoccus sp. AF10-3
  ref <308>: DATABASE ACCESSION NUMBER: NCBI ACCESSION: NZ_QUHS01000075.1
  ref <309>: DATABASE ENTRY DATE: 2019-04-01
  ref <313>: RELEVANT RESIDUES IN SEQ ID NO: (1)..(1271)
gttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggcctcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggtaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccgccttagagataaggcttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgagtccgtagcctaaccgtaaggagggcgcggccgaaggtaggggtggtaattagggtgaagtcgtaacaaggtagccgtatcggaaggtgcggctggatcacctcctttctaagga

SEQ ID NO: 2317 - DNA, 1208 bp, Butyricicoccus sp. AF24-19AC
  ref <308>: DATABASE ACCESSION NUMBER: NCBI ACCESSION: NZ_QUFU01000071.1
  ref <309>: DATABASE ENTRY DATE: 2019-04-01
  ref <313>: RELEVANT RESIDUES IN SEQ ID NO: (1)..(1208)
atccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccgccttagagataaggcttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaacc

SEQ ID NO: 2318 - DNA, 1538 bp, Butyricicoccus sp. AF35-5AC
  ref <308>: DATABASE ACCESSION NUMBER: NCBI ACCESSION: NZ_QUDX01000035.1
  ref <309>: DATABASE ENTRY DATE: 2019-04-01
  ref <313>: RELEVANT RESIDUES IN SEQ ID NO: (1)..(1538)
tttttagagagtttgatcctggctcaggatgaacgctggcggcgtgcctaacacatgcaagtcgaacggaactattttggaaactccttcgggagcggaatctttagtttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctagttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaaaaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggttcagagatgagccttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggagggcgcggccgaaggtaggggtggtaattagggtgaagtcgtaacaaggtagccgtatcggaaggtgcggctggatcacctcctttctaagga

SEQ ID NO: 2319 - DNA, 1538 bp, Butyricicoccus sp. AM05-1
  ref <308>: DATABASE ACCESSION NUMBER: NCBI ACCESSION: NZ_QUDG01000030.1
  ref <309>: DATABASE ENTRY DATE: 2019-04-01
  ref <313>: RELEVANT RESIDUES IN SEQ ID NO: (1)..(1538)
tttttagagagtttgatcctggctcaggatgaacgctggcggcgtgcctaacacatgcaagtcgaacggagtcgttttggaaatctcttcggagatggaattctcgacttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaagaaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccgtcttagagatagggcttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggagggcgcggccgaaggtaggggtggtaattagggtgaagtcgtaacaaggtagccgtatcggaaggtgcggctggatcacctcctttctaagga

SEQ ID NO: 2320 - DNA, 1537 bp, Butyricicoccus sp. AM18-35
  ref <308>: DATABASE ACCESSION NUMBER: NCBI ACCESSION: NZ_QUCQ01000017.1
  ref <309>: DATABASE ENTRY DATE: 2019-04-01
  ref <313>: RELEVANT RESIDUES IN SEQ ID NO: (1)..(1537)
ttttagagagtttgatcctggctcaggatgaacgctggcggcgtgcctaacacatgcaagtcgaacggaactattttggaaactccttcgggagcggaatctttagtttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgttggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccgccttagagataaggcttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgtaaggagggcgcggccgaaggtaggggtggtaattagggtgaagtcgtaacaaggtagccgtatcggaaggtgcggctggatcacctcctttctaagga

SEQ ID NO: 2321 - DNA, 1538 bp, Butyricicoccus sp. AM28-25
  ref <308>: DATABASE ACCESSION NUMBER: NCBI ACCESSION: NZ_QUJL01000035.1
  ref <309>: DATABASE ENTRY DATE: 2019-04-01
  ref <313>: RELEVANT RESIDUES IN SEQ ID NO: (1)..(1538)
tttttagagagtttgatcctggctcaggatgaacgctggcggcgtgcctaacacatgcaagtcgaacggagtcgttttggaaatctcttcggagatggaattctcgacttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggttcagagatgagccttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgtaaggagggcgcggccgaaggtaggggtggtaattagggtgaagtcgtaacaaggtagccgtatcggaaggtgcggctggatcacctcctttctaagga

SEQ ID NO: 2322 - DNA, 1534 bp, Butyricicoccus sp. AM29-23AC
  ref <308>: DATABASE ACCESSION NUMBER: NCBI ACCESSION: NZ_QUJF01000065.1
  ref <309>: DATABASE ENTRY DATE: 2019-04-01
  ref <313>: RELEVANT RESIDUES IN SEQ ID NO: (1)..(1534)
tttttagagagtttgatcctggctcaggatgaacgctggcggcgtgcctaacacatgcaagtcgaacggagtcgttttggaaaatccttcgggattggaattctcgacttagtggcggacgggtgagtaacgcgtgagcaatctgcctttaagagggggataacagtcggaaacggctgctaataccgcataaagcattgaattcgcatgttttcgatgccaaaggagcaatccgcttttagatgagctcgcgtctgattagctagttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggcctcgggttgtaaagatctttaattcgggacgaattttgacggtaccgaaagaataagctccggctaactacgtgccagcagccgcggtaatacgtagggagcaagcgttatccggatttactgggtgtaaagggcgcgcaggcgggccggcaagttggaagtgaaatccgggggcttaacccccgaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggccttgacatcccgatgaccgtcctagagatagggcttctcttcggagcatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatggcctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgagtccgtagcctaaccgcaaggagggcgcggccgaaggtaggggtggtaattagggtgaagtcgtaacaaggtagccgtatcggaaggtgcggctggatcacctcctttctaagga

SEQ ID NO: 2323 - DNA, 1538 bp, Butyricicoccus sp. AM32-19
  ref <308>: DATABASE ACCESSION NUMBER: NCBI ACCESSION: NZ_QUIX01000041.1
  ref <309>: DATABASE ENTRY DATE: 2019-04-01
  ref <313>: RELEVANT RESIDUES IN SEQ ID NO: (1)..(1538)
tttttagagagtttgatcctggctcaggatgaacgctggcggcgtgcctaacacatgcaagtcgaacggaactattttggaaactccttcgggagcggaatctttagtttagtggcggacgggtgagtaacgcgtgagcaatctgcctttaagagggggataacagtcggaaacggctgctaataccgcataaagcatcaaattcgcatgtttttgatgccaaaggagcaatccgcttttagatgagctcgcgtctgattagctagttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggttcagagatgagccttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggagggcgcggccgaaggtaggggtggtaattagggtgaagtcgtaacaaggtagccgtatcggaaggtgcggctggatcacctcctttctaagga

SEQ ID NO: 2324 - DNA, 1536 bp, Butyricicoccus sp. AM42-5AC
  ref <308>: DATABASE ACCESSION NUMBER: NCBI ACCESSION: NZ_QUIJ01000027.1
  ref <309>: DATABASE ENTRY DATE: 2019-04-01
  ref <313>: RELEVANT RESIDUES IN SEQ ID NO: (1)..(1536)
tttttagagagtttgatcctggctcaggatgaacgctggcggcgtgcctaacacatgcaagtcgaacggaggcgttttggaaaatccttcgggattggaattctcgacttagtggcggacgggtgagtaacgcgtgagcaatctgcctttaagagggggataacagtcggaaacggctgctaataccgcataaagcattgaattcgcatgttttcgatgccaaaggagcaatccgcttttagatgagctcgcgtctgattagctagttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaattcgggacgaattttgacggtaccgaaagaataagctccggctaactacgtgccagcagccgcggtaatacgtagggagcaagcgttatccggatttactgggtgtaaagggcgcgcaggcgggccggcaagttggaagtgaaatccgggggcttaacccccgaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggccttgacatcccgatgaccgtcctagagatagggcttctcttcggagcatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatggcctgggctacacacgtactacaatggcagtcatacagagggaagcaaagccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggagggcgcggccgaaggtaggggtggtaattagggtgaagtcgtaacaaggtagccgtatcggaaggtgcggctggatcacctcctttctaagga

SEQ ID NO: 2325 - DNA, 1539 bp, Butyricicoccus sp. GAM44
  ref <308>: DATABASE ACCESSION NUMBER: NCBI ACCESSION: NZ_BFBU01000001.1
  ref <309>: DATABASE ENTRY DATE: 2019-04-01
  ref <313>: RELEVANT RESIDUES IN SEQ ID NO: (1)..(1539)
tttttagagagtttgatcctggctcaggatgaacgctggcggcgtgcctaacacatgcaagtcgaacggaactattttggaaactccttcgggagcggaatctttagtttagtggcggacgggtgagtaacgcgtgagcaatctgcctttaagagggggataacagtcggaaacggctgctaataccgcataaagcattgaaaccgcatgattttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggttcagagatgagccttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccttcttggagggcgcggccgaaggtaggggtggtaattagggtgaagtcgtaacaaggtagccgtatcggaaggtgcggctggatcacctcctttctaagga

SEQ ID NO: 2326 - DNA, 1536 bp, Butyricicoccus sp. OF10-2
  ref <308>: DATABASE ACCESSION NUMBER: NCBI ACCESSION: NZ_QUMC01000055.1
  ref <309>: DATABASE ENTRY DATE: 2019-04-01
  ref <313>: RELEVANT RESIDUES IN SEQ ID NO: (1)..(1536)
tttttagagagtttgatcctggctcaggatgaacgctggcggcgtgcctaacacatgcaagtcgaacggagtcgttttggaaaatccttcgggattggaattctcgacttagtggcggacgggtgagtaacgcgtgagcaatctgcctttaagagggggataacagtcggaaacggctgctaataccgcataaagcattaaattcgcatgtttttgatgccaaaggagcaatccgcttttagatgagctcgcgtctgattagctagttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggcctcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggttcagagatgagccttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgagtccgtagcctaaccgtaaggagggcgcggccgaaggtaggggtggtaattagggtgaagtcgtaacaaggtagccgtatcggaaggtgcggctggatcacctcctttctaagga

SEQ ID NO: 2327 - DNA, 1537 bp, Butyricicoccus sp. OF13-6
  ref <308>: DATABASE ACCESSION NUMBER: NCBI ACCESSION: NZ_QULY01000061.1
  ref <309>: DATABASE ENTRY DATE: 2019-04-01
  ref <313>: RELEVANT RESIDUES IN SEQ ID NO: (1)..(1537)
tttttagagagtttgatcctggctcaggatgaacgctggcggcgtgcctaacacatgcaagtcgaacggagtcgttttggaaatctcttcggagatggaattctcgacttagtggcggacgggtgagtaacgcgtgagcaatctgcctttaagagggggataacagtcggaaacggctgctaataccgcataaagcattaaattcgcatgtttttgatgccaaaggagcaatccgcttttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggcctcgggttgtaaagatctttaatcagggacgaaacaaatgacggtacctgaagaataagctccggctaactacgtgccagcagccgcggtaatacgtagggagcaagcgttatccggatttactgggtgtaaagggcgcgcaggcgggccggcaagttggaagtgaaatctatgggcttaacccataaactgctttcaaaactgttggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccgccttagagataaggcttttcttcggaacatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgagtccgtagcctaaccttcttggagggcgcggccgaaggtaggggtggtaattagggtgaagtcgtaacaaggtagccgtatcggaaggtgcggctggatcacctcctttctaagga

SEQ ID NO: 2328 - DNA, 1536 bp, Butyricicoccus sp. OM04-18BH
  ref <308>: DATABASE ACCESSION NUMBER: NCBI ACCESSION: NZ_QULN01000011.1
  ref <309>: DATABASE ENTRY DATE: 2019-04-01
  ref <313>: RELEVANT RESIDUES IN SEQ ID NO: (1)..(1536)
tttttagagagtttgatcctggctcaggatgaacgctggcggcgtgcctaacacatgcaagtcgaacggagtcgttttggaaaatccttcgggattggaattctcgacttagtggcggacgggtgagtaacgcgtgagcaatctgcctttaagagggggataacagtcggaaacggctgctaataccgcataaagcattgaattcgcatgttttcgatgccaaaggagcaatccgcttttagatgagctcgcgtctgattagctagttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggccttcgggttgtaaagatctttaattcgggacgaattttgacggtaccgaaagaataagctccggctaactacgtgccagcagccgcggtaatacgtagggagcaagcgttatccggatttactgggtgtaaagggcgcgcaggcgggccggcaagttggaagtgaaatccgggggcttaacccccgaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggccttgacatcccgatgaccgtcctagagatagggcttctcttcggagcatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatggcctgggctacacacgtactacaatggcagtcatacagagggaagcaaaaccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggagggcgcggccgaaggtaggggtggtaattagggtgaagtcgtaacaaggtagccgtatcggaaggtgcggctggatcacctcctttctaagga

SEQ ID NO: 2329 - DNA, 1532 bp, Butyrivibrio crossotus
  ref <308>: DATABASE ACCESSION NUMBER: NCBI ACCESSION: NZ_GG663514.1
  ref <309>: DATABASE ENTRY DATE: 2019-04-01
  ref <313>: RELEVANT RESIDUES IN SEQ ID NO: (1)..(1532)
tttatatgagagtttgatcctggctcaggatgaacgctggcggcgtgcttaacacatgcaagtcgaacgaagcacttcataaagcttgctttaagaagtgacttagtggcggacgggtgagtaacgcgtgggtaacctgccttacacagggggataacagttagaaatgactgctaataccgcataaaacagcagagtcgcatgactcaactgtcaaagatttatcggtgtaagatggacccgcgtctgattagcttgttggtggggtaacggcctaccaaggcgacgatcagtagccggcctgagagggtgaacggccacattgggactgagacacggcccaaactcctacgggaggcagcagtggggaatattggacaatgggcgaaagcctgatccagcgacgccgcgtgagcgatgaagtatttcggtatgtaaagctctatcagcagggaagaaaacgacggtacctgactaagaagccccggctaactacgtgccagcagccgcggtaatacgtagggggcaagcgttatccggatttactgggtgtaaagggagcgtagacggcatcacaagtcagaagtgaaaatccggggctcaaccccggaactgcttttgaaactgtggagctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttgggtttcataagaagctcggtgccggcgcaaacgcattaagtattccacctggggagtacgttcgcaagaatgaaactcaaaggaattgacggggacccgcacaagcggtggagcatgtggtttaattcgaagcaacgcgaagaaccttaccaagtcttgacatcccgttgacctgttatgtaatgtaacatctcttcggagcaacggagacaggtggtgcatggttgtcgtcagctcgtgtcgtgagatgttgggttaagtcccgcaacgagcgcaacccttgtccttagtagccagcagtaagatgggcactctagggagactgccggggataactcggaggaaggtggggacgacgtcaaatcatcatgccccttatgacttgggctacacacgtgctacaatggcgtaaacaaagggaagcgaacctgtgaaggcaagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcgtaaatgcccgaagtcggtgacctaaccgtaaggaaggagccgccgaaggcaggtatgataactggggtgaagtcgtaacaaggtagccgtatcggaaggtgcggctggatcacctcctttctaaggaa

SEQ ID NO: 2330 - DNA, 1555 bp, Butyrivibrio sp. AE2032
  ref <308>: DATABASE ACCESSION NUMBER: NCBI ACCESSION: NZ_JNLF01000003.1
  ref <309>: DATABASE ENTRY DATE: 2019-04-01
  ref <313>: RELEVANT RESIDUES IN SEQ ID NO: (1)..(1555)
tttaacgtgagagttcgatcctggctcaggatgaacgctggcggcgtgcctaacacatgcaagtcgaacggagtttactcgctgaagcggtttcggccaattcttgagtaaacttagtggcggacgggtgagtaacgcgtgggcaacctgcctcatactgggggatagcagttggaaacgactgataataccgcataagcgcacagagtcgcatgactcagtgtgaaaaactccggtggtatgagatgggcccgcgtcagattagctagttggtaaggtaacggcttaccaaggcgacgatctgtagccggactgagaggtcggacggccacattgggactgagacacggcccaaactcctacgggaggcagcagtgggggatattgcacaatggaggaaactctgatgcagcgacgccgcgtgagtgaagaagtatttcggtatgtaaagctctatcagcagggaagaaaggctcgcaagagagatgacggtacctgactaagaagccccggctaactacgtgccagcagccgcggtaatacgtagggggcaagcgttatccggatttactgggtgtaaagggagcgcagacggcttggcaagtctgaagtgaaaccccacggctcaaccgtgggcttgctttggaaactgtcaggctagagtactggagaggtaagcggaattcctagtgtagcggtgaaatgcgtagatattaggaggaacatcggtggcgaaggcggcttactggacagcaactgacgttgaggctcgaaggcgtggggagcaaacaggattagataccctggtagtccacgcggtaaacgatgaatactaggtgttgggagacatagtttctcagtgccgtcgctaacgcagtaagtattccacctggggagtacgttcgcaagaatgaaactcaaaggaattgacggggacccgcacaagcggtggagcatgtggtttaattcgaagcaacgcgaagaaccttaccagatcttgagatcctgctgaatacagggtaatgcctgtaggccttcgggacagtagagacaggtggtgcatggttgtcgtcagctcgtgtcgtgagatgttgggttaagtcccgcaacgagcgcaacccttgtccatagtagccagcagtaagatgggaactctatggagactgccagggataacctggaggaaggtggggatgacgtcaaatcatcatgccccttatgatctgggccacacacgtgctacaatgtcgtaacaaagggaagcgacggagcgatcctgagcaaatctcaaaaataacgacccagttcggactgtaggctgcaacccgcctgcacgaagctggaatcgctagtaatcgcagatcagcatgctgcggtgaatacgttcccgggtcttgtacacaccgcccgtcacaccatgggagtcggaaatgcccgaagccggtgacttaaccgaaaggagagagccgtcgaaggcaggtcggataactggggtgaagtcgtaacaaggtagccgtaggagaacctgcggctggatcacctcctttctaaggaa

SEQ ID NO: 2331 - DNA, 1538 bp, Caballeronia arationis; identical to SEQ ID NO: 2300
  ref <308>: DATABASE ACCESSION NUMBER: NCBI ACCESSION: NZ_FCOG02000237.1
  ref <309>: DATABASE ENTRY DATE: 2019-04-01
  ref <313>: RELEVANT RESIDUES IN SEQ ID NO: (1)..(1538)

SEQ ID NO: 2332 - DNA, 1538 bp, Caballeronia arvi
  ref <308>: DATABASE ACCESSION NUMBER: NCBI ACCESSION: NZ_FCOM02000208.1
  ref <309>: DATABASE ENTRY DATE: 2019-04-01
  ref <313>: RELEVANT RESIDUES IN SEQ ID NO: (1)..(1538)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaaccacctggctaatatccgggtgggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctcctttctcg

SEQ ID NO: 2333 - DNA, 1538 bp, Caballeronia calidae
  ref <308>: DATABASE ACCESSION NUMBER: NCBI ACCESSION: NZ_FCOX02000168.1
  ref <309>: DATABASE ENTRY DATE: 2019-04-01
  ref <313>: RELEVANT RESIDUES IN SEQ ID NO: (1)..(1538)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcgccgctaatatcggtggaggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagagggaggtagaattccacgtgtagcagtgaaatgcgtagagatgtggaggaataccgatggcgaaggcagcctcctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctcctttctcg

SEQ ID NO: 2334 - DNA, 1538 bp, Caballeronia catudaia
  ref <308>: DATABASE ACCESSION NUMBER: NCBI ACCESSION: NZ_FCOF02000102.1
  ref <309>: DATABASE ENTRY DATE: 2019-04-01
  ref <313>: RELEVANT RESIDUES IN SEQ ID NO: (1)..(1538)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctgagggagaaagcgggggatcttcggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcgtccctaatatggatggaggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaaccgtaaggagggcgcttaccacggtgggattcatgactggggtgaagtcgtaacaaggtagccgtatcggaaggtgcggctggatcacctcctttctcg

SEQ ID NO: 2335 - DNA, 1538 bp, Caballeronia choica
  ref <308>: DATABASE ACCESSION NUMBER: NCBI ACCESSION: NZ_FCON02000391.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacttcctggttaatacctggggaggctgacggtaccggaagaataagcaccggctaactacgtgccagcagccgcggtaatacgtagggtgcgagcgttaatcggaattactgggcgtaaagcgtgcgcaggcggtttgttaagacagatgtgaaatccccgggcttaacctgggaactgcatttgtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggctgccaacccgtgagggggagctaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2336 - DNA, 1538 bp, Caballeronia concitans
  ref <308>: DATABASE ACCESSION NUMBER: NCBI ACCESSION: NZ_FCNV02000034.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaggaaagcgggggatcttcggacctcgcgctgcaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcgtccctaatatggatggaggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctagagtgtggcagagggaggtagaattccacgtgtagcagtgaaatgcgtagagatgtggaggaataccgatggcgaaggcagcctcctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2337 - DNA, 1538 bp, Caballeronia fortuita
  ref <308>: DATABASE ACCESSION NUMBER: NCBI ACCESSION: NZ_FCNX02000042.1
  ref <309>: DATABASE ENTRY DATE: 2019-04-01
  ref <313>: RELEVANT RESIDUES IN SEQ ID NO: (1)..(1538)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaaccatcgccctaatatggtggtgggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagtctgctgagaggcggacgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaaccgtaaggagggcgcttaccacggtgggattcatgactggggtgaagtcgtaacaaggtagccgtatcggaaggtgcggctggatcacctcctttctcg

SEQ ID NO: 2338 - DNA, 1538 bp, Caballeronia glebae
  ref <308>: DATABASE ACCESSION NUMBER: NCBI ACCESSION: NZ_FCOJ02000126.1
  ref <309>: DATABASE ENTRY DATE: 2019-04-01
  ref <313>: RELEVANT RESIDUES IN SEQ ID NO: (1)..(1538)
ttaaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgttcgggaagaaaacttcgatcctaatatggttggaggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagagggaggtagaattccacgtgtagcagtgaaatgcgtagagatgtggaggaataccgatggcgaaggcagcctcctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctcctttctcg

SEQ ID NO: 2339 - DNA, 1538 bp, Caballeronia humi
  ref <308>: DATABASE ACCESSION NUMBER: NCBI ACCESSION: NZ_FCNW02000121.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacctcttggataatacctgagggggatgacggtaccggaagaataagcaccggctaactacgtgccagcagccgcggtaatacgtagggtgcgagcgttaatcggaattactgggcgtaaagcgtgcgcaggcggtttgttaagacagatgtgaaatccccgggcttaacctgggaactgcatttgtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgctaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2340 - DNA, 1540 bp, Caballeronia hypogeia
  ref <308>: DATABASE ACCESSION NUMBER: NCBI ACCESSION: NZ_FCOA02000075.1
  ref <309>: DATABASE ENTRY DATE: 2019-04-01
  ref <313>: RELEVANT RESIDUES IN SEQ ID NO: (1)..(1540)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaactttgtccctaatatggatggaggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaacctgcgaaggagggcgcttaccacggtgggattcatgactggggtgaagtcgtaacaaggtagccgtatcggaaggtgcggctggatcacctcctttctcg

SEQ ID NO: 2341 - DNA, 1538 bp, Caballeronia pedi
  ref <308>: DATABASE ACCESSION NUMBER: NCBI ACCESSION: NZ_FCOE02000091.1
  ref <309>: DATABASE ENTRY DATE: 2019-04-01
  ref <313>: RELEVANT RESIDUES IN SEQ ID NO: (1)..(1538)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatcttcggacctcgcgctgcaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcgtccctaatatggatggaggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcccgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaaccgcaaggagggcgcttaccacggtgggattcatgactggggtgaagtcgtaacaaggtagccgtatcggaaggtgcggctggatcacctcctttctcg

SEQ ID NO: 2342 - DNA, 1540 bp, Caballeronia peredens
  ref <308>: DATABASE ACCESSION NUMBER: NCBI ACCESSION: NZ_FCOH02000055.1
  ref <309>: DATABASE ENTRY DATE: 2019-04-01
  ref <313>: RELEVANT RESIDUES IN SEQ ID NO: (1)..(1540)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatccttcgggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaaccatcgccctaatatggtggtgggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2343 - DNA, 1538 bp, Caballeronia ptereochthonis
  ref <308>: DATABASE ACCESSION NUMBER: NCBI ACCESSION: NZ_FCOB02000074.1
  ref <309>: DATABASE ENTRY DATE: 2019-04-01
  ref <313>: RELEVANT RESIDUES IN SEQ ID NO: (1)..(1538)
ttgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatcttcggacctcgcgctgcaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaaccgccgccctaatatggtggtgggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggcttggagtgtggcagagggaggtagaattccacgtgtagcagtgaaatgcgtagagatgtggaggaataccgatggcgaaggcagcctcctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagtctgctgagaggcggatgtgctcgaaagagaaccgacgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2344 - DNA, 1538 bp, Caballeronia sordidicola
  ref <308>: DATABASE ACCESSION NUMBER: NCBI ACCESSION: NZ_RSET01000001.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatcgcaagacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacttctgccctaatacggcgggaggatgacggtaccggaagaataagcaccggctaactacgtgccagcagccgcggtaatacgtagggtgcgagcgttaatcggaattactgggcgtaaagcgtgcgcaggcggttcgttaagacagatgtgaaatccccgggcttaacctgggaactgcatttgtgactggcgagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggctgccaacccgtgagggggagctaatcccagaaaaccgatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2345 - DNA, 1540 bp, Caballeronia telluris
  ref <308>: DATABASE ACCESSION NUMBER: NCBI ACCESSION: NZ_FCNZ02000083.1
  ref <309>: DATABASE ENTRY DATE: 2019-04-01
  ref <313>: RELEVANT RESIDUES IN SEQ ID NO: (1)..(1540)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctggagtgggggatagcccggcgaaagccggattaataccgcatacgctctaaggaggaaagggggggatctttcgggacctctcgctcaaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgcaagcctgatccagcaatgccgcgtgtgtgaagaaggccttcgggttgtaaagcacttttgtccggaaagaaaacttttgccctaatacggtgagaggatgacggtaccggaagaataagcaccggctaactacgtgccagcagccgcggtaatacgtagggtgcgagcgttaatcggaattactgggcgtaaagcgtgcgcaggcggtctgttaagacagatgtgaaatccccgggcttaacctgggaactgcatttgtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgctaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2346 - DNA, 1541 bp, Caballeronia temeraria
  ref <308>: DATABASE ACCESSION NUMBER: NCBI ACCESSION: NZ_FCOI02000076.1
  ref <309>: DATABASE ENTRY DATE: 2019-04-01
  ref <313>: RELEVANT RESIDUES IN SEQ ID NO: (1)..(1541)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacttcgaggttaatacccttggaggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagaggggggtagaattccacgtgtagcagtgaaatgcgtagagatgtggaggaataccgatggcgaaggcagccccctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaagtctgctgagaggtggacgtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggtttcaccagaagtaggtagcctaacctgcaaaggagggcgcttaccacggtgggattcatgactggggtgaagtcgtaacaaggtagccgtatcggaaggtgcggctggatcacctcctttctcg

SEQ ID NO: 2347 - DNA, 1538 bp, Caballeronia terrestris
  ref <308>: DATABASE ACCESSION NUMBER: NCBI ACCESSION: NZ_FCOL02000158.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgacctaagggagaaagcgggggatcttcggacctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaaccttcgagctaataccttgaggggatgacggtaccggaagaataagcaccggctaactacgtgccagcagccgcggtaatacgtagggtgcgagcgttaatcggaattactgggcgtaaagcgtgcgcaggcggtttgttaagacagatgtgaaatccccgggcttaacctgggaactgcatttgtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggtcgctaagccgcgaggtggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2348 - DNA, 1539 bp, Caballeronia turbans
  ref <308>: DATABASE ACCESSION NUMBER: NCBI ACCESSION: NZ_FCOD02000076.1
  ref <309>: DATABASE ENTRY DATE: 2019-04-01
  ref <313>: RELEVANT RESIDUES IN SEQ ID NO: (1)..(1539)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggatcttcggacctcgcgctgcaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaaccatcgccctaatatggtggtgggatgacggtaccggaagaataagcaccggctaactacgtgccagcagccgcggtaatacgtagggtgcgagcgttaatcggaattactgggcgtaaagcgtgcgcaggcggtctgttaagaccgatgtgaaatccccgggcttaacctgggaactgcattggtgactggcaggctttgagtgtggcagagggaggtagaattccacgtgtagcagtgaaatgcgtagagatgtggaggaataccgatggcgaaggcagcctcctgggccaacactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggcgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaagccgcgaggcggagccaatcccagaaaaccgatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2349 - DNA, 1538 bp, Caballeronia udeis
  ref <308>: DATABASE ACCESSION NUMBER: NCBI ACCESSION: NZ_RJKG01000001.1
  ref <309>: DATABASE ENTRY DATE: 2019-04-01
  ref <313>: RELEVANT RESIDUES IN SEQ ID NO: (1)..(1538)
attgaactgaagagtttgatcctggctcagattgaacgctggcggcatgccttacacatgcaagtcgaacggcagcacgggggcaaccctggtggcgagtggcgaacgggtgagtaatacatcggaacgtgtcctgtagtgggggatagcccggcgaaagccggattaataccgcatacgatctacggaagaaagcgggggaccgaaaggcctcgcgctataggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggggaaaccctgatccagcaatgccgcgtgtgtgaagaaggccttcgggttgtaaagcacttttgtccggaaagaaaacttctgccctaatacggtgggaggatgacggtaccggaagaataagcaccggctaactacgtgccagcagccgcggtaatacgtagggtgcgagcgttaatcggaattactgggcgtaaagcgtgcgcaggcggttcgttaagacagatgtgaaatccccgggcttaacctgggaactgcatttgtgactggcgagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaaccctgctgaaaggtgggggtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggctgccaacccgtgagggggagctaatcccagaaaaccgatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttctcg

SEQ ID NO: 2350 - DNA, 1571 bp, Caecibacter massiliensis
  ref <308>: DATABASE ACCESSION NUMBER: NCBI ACCESSION: NZ_LT608311.1
  ref <309>: DATABASE ENTRY DATE: 2019-04-01
  ref <313>: RELEVANT RESIDUES IN SEQ ID NO: (1)..(1571)
atggagagtttgatcctggctcaggacgaacgctggcggcgtgcttaacacatgcaagtcgaacgagaggacatggaaagcttgctttttatggaatcgagtggcaaacgggtgagtaacgcgtaagcaacctgccctgcagatggggacaacagctggaaacggctgctaataccgaatacgaagcagctcccgcatgggggcagcttgaaaggatggcctctgaatatgctatcgctgcaggaggggcttgcgtctgattagctggttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgagtgaagacggccttcgggttgtaaagctctgttatacgggacgaacgggcgggatgctaataccatcctgttgtgacggtaccgtaagagaaagccacggctaactacgtgccagcagccgcggtaatacgtaggtggcaagcgttgtccggaattattgggcgtaaagggtgcgcaggcggtctcttaagtctgtcttaaaagtgcggggctcaaccccgtgaggggacggaaactgggagactggagtatcggagaggaaagcagaattcctagtgtagcggtgaaatgcgtagatattaggaggaataccagtggcgaaagcggctttctggacgacaactgacgctgaggcacgaaagccaggggagcgaacgggattagataccccggtagtcctggccgtaaacgatgggtactaggtgtaggaggtatcgaccccttctgtgccggagttaacgcaataagtaccccgcctggggagtacggccgcaaggctgaaactcaaaggaattgacgggggcccgcacaagcggtggagtatgtggtttaattcgacgcaacgcgaagaaccttaccaagccttgacattgatcgcaatggatagagatatccagttcctcttcggaggacgagaaaacaggtggtgcacggctgtcgtcagctcgtgtcgtgagatgttgggttaagtcccgcaacgagcgcaacccctatcttctgttaccagcacgtgatggtggggactcaggagagactgccgcagacaatgcggaggaaggcggggatgacgtcaagtcatcatgccccttatggcttgggctacacacgtactacaatggctcttaatagagggaagcgaaagggcgacctggagcaaaccccaaaaacagagtcccagttcggattgcaggctgcaacccgcctgcatgaaggaggaatcgctagtaatcgcaggtcagcatactgcggtgaatacgttcccgggccttgtacacaccgcccgtcacaccacgaaagtcattcacacccgaagccggtgaggcaaccgcaaggaaccagccgtcgaaggtgggggcgatgattggggtgaagtcgtaacaaggtagccgtatcggaaggtgcggctggatcacctcctttctaggga

SEQ ID NO: 2351 - DNA, 1708 bp, Caedimonas varicaedens
  ref <308>: DATABASE ACCESSION NUMBER: NCBI ACCESSION: NZ_BBVC01000023.1
  ref <309>: DATABASE ENTRY DATE: 2019-04-01
  ref <313>: RELEVANT RESIDUES IN SEQ ID NO: (1)..(1708)
tcaaacatgagagtttgatcctggctcagaacgaacgctggcggcacgcctaacacatgcaagtcgaacgagggcattctttcggggatgttcctagtggcggacgggtgagtaacgcgtgggaatctgcctgatagtgggggataactgttggaaacgacagctaataccgcatacgctggagagtagaaaagagaagcaggaaaggaaaggtaccgagggaaatcttttggtatttctgttttctgattgggtgaaggaaagggccttgaaaaccttttcgttttcctcaagagagaagttgggaaagggtgtcaattctttccggatttcttatgggggagaggttttgaaaacctttctgcattgtttcttttttctcctctccaggaaagatttatcgctatcagatgagcccgcgtcagattaggtagttggtgaggtaaaggctcaccaagccaatgatctgtagctggtctgagaggatgaccagccacactgggactgagacacggcccagactcctacgggaggcagcagtggggaatcttggacaatgggggcaaccctgatccagcgatgccgcgtgaatgaagaaggccttagggttgtaaagttctttcacccgtgacgataatgacggtagcgggagaagaagccccggctaactccgtgccagcagccgcggtaagacggagggggctagcgttgttcggaatgactgggcgtaaagggcgtgtaggctgttgatcaagtcaagcgtgaaagcctcgggcttaacccgagaactgcgtttgatactggttgacttgaggacgagagaggaaagtggaattccgagtgtagaggtgaaattcgtagatattcggaggaacatcagaggcgaaggcggctttctggctcgtatctgacgctgaggcgcgaaagcgtggggagcaaacaggattagataccctggtagtccacgctgtaaacgatgagtgctagacgttggggggttccccttcagtgtcgcagctaacgcattaagcactccgcctggggagtacggtcgcaagattaaaactcaaaggaattgacgggggcccgcacaagcggtggagcatgtggtttaattcgaagcaacgcgcagaaccttaccagctcttgacatggggattatggagaggagagattctttccttcagttcggctggatcccgcacaggtgctgcatggctgtcgtcagctcgtgtcgtgagatgttgggttaagtcccgcaacgagcgcaaccctcatttttagttgccatcaggtttggctgggtactctaaagaaactgccggtgataaaccggaggaaggtggggatgacgtcaagtcctcatggcccttatgggctgggctacacacgtgctacaatggcggtgacagagaggagcaaaggggcgacctggagcgaatctttaaaagccgtctcagttcggattgcactctgcaactcgagtgcatgaagttggaatcgctagtaatcgcggatcagcatgccgcggtgaatacgttcacgggccttgtacacaccgcccgtcataccatgggagttgattcaaccttaaggcggtgagctaaccgaaagggagcagccgaccacggtggggtcaatgactggggtaaagtcgtaacaaggtagccgtaggggaacctgcggctggatcacctcctttctaagg

SEQ ID NO: 2352 - DNA, 1266 bp, Caenibacillus caldisaponilyticus
  ref <308>: DATABASE ACCESSION NUMBER: NCBI ACCESSION: NZ_BDDQ01000128.1
  ref <309>: DATABASE ENTRY DATE: 2019-04-01
  ref <313>: RELEVANT RESIDUES IN SEQ ID NO: (1)..(1266)
tagccgacctgagagggtgatcggccacactgggactgagacacggcccagactcctacgggaggcagcagtagggaatcttccgcaatggacgcaagtctgacggagcgacgccgcgtgagcgaggaaggccttcgggtcgtaaagctctgttgtcggagacgaacaaacgccataggaaatgatggcgtcctgacggtatccgacgagaaagccccggctaactacgtgccagcagccgcggtaatacgtagggggcgagcgttgtccggaattattgggcgtaaagcgcgcgcaggcggccctttaagtctgatgtgaaagcccgcggctcaaccgcggatgggcattggaaactggagggcttgagtgcaggagaggagagtggaattccacgtgtagcggtgaaatgcgtagagatgtggaggaacaccagtggcgaaagcggctctctggcctgtaactgacgctgaggcgcgaaagcgtggggagcaaacaggattagataccctggtagtccacgccgtaaacgatgagtgctaggtgttaggggggtcaaaccccttagtgctgaaggtaacccattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaccgccctagagatagggttttcccccttcggggggacagagtgacaggtggtgcatggttgtcgtcagctcgtgtcgtgagatgttgggttaagtcccgcaacgagcgcaacccttgacgttagttgccagcattgagttgggcactctaacgtgactgccggtgacaaaccggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtctgcaacacccgaagtcggtgcgccaacccgcaagggaggcagccgccgaaggtggggcagatgattggggtgaagtcgtaacaaggtagccgtatcggaaggtgcggctggatcacctcctttctaa

SEQ ID NO: 2353 - DNA, 1492 bp, Caenispirillum bisanense
  ref <308>: DATABASE ACCESSION NUMBER: NCBI ACCESSION: NZ_OCNJ01000036.1
  ref <309>: DATABASE ENTRY DATE: 2019-04-01
  ref <313>: RELEVANT RESIDUES IN SEQ ID NO: (1)..(1492)
tcaacatgagagtttgatcctggctcagaacgaacgctggcggcaggcctaacacatgcaagtcgaacgcacccttcggggtgagtggcgcacgggtgagtaacgcgtgggaaattgccttggagtgggggataaccactggaaacggtggctaataccgcatacgccctacgggggaaagatttatcgctccgagatgtgcccgcgtcggattaggtagttggtgaggtaatggctcaccaagccgacgatccgtagctggtctgagaggatgatcagccacactgggactgagacacggcccagactcctacgggaggcagcagtggggaatattggacaatgggcgcaagcctgatccagccatgccgcgtgagtgaagaaggccttcgggttgtaaagctctttcagaggtgacgatgatgacggtaacctcagaagaagccccggctaacttcgtgccagcagccgcggtaatacgaagggggctagcgttgttcggaattactgggcgtaaagcgcgcgtaggcggtgtgcatagtcaggggtgaaatcccggggctcaacctcggaattgcctttgatactggcgcacttgaatccgtgagagggtggtggaatgaccagtgtagaggtgaaattcgtagatattggtcggaacaccagtggcgaaggcggccacctggcgcggtattgacgctgaggcgcgaaagcgtggggagcaaacaggattagataccctggtagtccacgccgtaaacgatgagtgctagctgttggcctgcttgcaggtcagtggcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatggggatcgcggtcttggagacaagactttcagttcggctggatcccgcacaggtgctgcatggctgtcgtcagctcgtgtcgtgagatgttgggttaagtcccgcaacgagcgcaaccctcgctctcagttgccagcattcagttgggcactctgggggaactgccggtgacaagccggaggaaggtggggatgacgtcaagtcctcatggcccttacgggctgggctacacacgtgctacaatggtgactacagtgggcagccacacagcgatgtggagctaatcccaaaaagtcatctcagttcggattgcactctgcaactcgggtgcatgaagtcggaatcgctagtaatcgtggatcagcacgccacggtgaatacgttcccgggccttgtacacaccgcccgtcacaccatgggagttggctttacccgaagacgatgcgccaaccggcaacggaggcagtcggccacggtaaggtcagcgactggggtgaagtcgtaacaaggtagccgtaggggaacctgcggctggatcacctcctttcaagg

SEQ ID NO: 2354 - DNA, 1497 bp, Caenispirillum salinarum
  ref <308>: DATABASE ACCESSION NUMBER: NCBI ACCESSION: NZ_ANHY01000023.1
  ref <309>: DATABASE ENTRY DATE: 2019-04-01
  ref <313>: RELEVANT RESIDUES IN SEQ ID NO: (1)..(1497)
tcaagatcaacatgagagtttgatcctggctcagaacgaacgctggcggcaggcctaacacatgcaagtcgaacgctctcttcggagagagtggcgcacgggtgagtaacgcgtgggaaactgccctggagtgggggataaccgctggaaacggcggctaataccgcatacgccctacgggggaaagatttatcgctccaggatgtgcccgcgtcggattaggtagttggtggggtaacggcccaccaagccgacgatccgtagctggtctgagaggatgatcagccacactgggactgagacacggcccagactcctacgggaggcagcagtggggaatattggacaatgggcgcaagcctgatccagccatgccgcgtgagtgaagaaggccttcgggttgtaaagctctttcagaagtgacgatgatgacggtaacttcagaagaagccccggctaacttcgtgccagcagccgcggtaatacgaagggggcaagcgttgttcggaattactgggcgtaaagcgcgcgtaggcggtgtgcatagtcaggggtgaaatcccggggctcaacctcggaattgcctttgatactggcacgcttgaatccgtgagagggtggtggaatggccagtgtagaggtgaaattcgtagatattggccggaacaccagtggcgaaggcggccacctggcgcggtattgacgctgaggcgcgaaagcgtggggagcaaacaggattagataccctggtagtccacgccgtaaacgatgagtgctagctgttggcctgcttgcaggtcagtggcgcagctaacgcattaagcactccgcctggggagtacggccgcaaggttaaaactcaaaggaattgacgggggcccgcacaagcggtggagcatgtggtttaattcgaagcaacgcgcagaaccttaccagcccttgacatggggatcgcggtgtcagagatgacactttcagttcggctggatcccgcacaggtgctgcatggctgtcgtcagctcgtgtcgtgagatgttgggttaagtcccgcaacgagcgcaaccctcgcccttagttgccagcattgagttgggcactctaggggaactgccgatgacaagtcggaggaaggtggggatgacgtcaagtcctcatggcccttacgggctgggctacacacgtgctacaatggcatctacaatgggcagccacacggcgacgtggagctaatctccaaaagatgtctcagttcggattgcactctgcaactcgagtgcatgaagtcggaatcgctagtaatcgtggatcagcatgccacggtgaatacgttcccgggccttgtacacaccgcccgtcacaccatgggagttggctttacccgaagacggtgcgccaaccgcaaggaggcagccggccacggtaaggtcagcgactggggtgaagtcgtaacaaggtagccgtaggggaacctgcggctggatcacctcctttcaagga

SEQ ID NO: 2355 - DNA, 1568 bp, Caldalkalibacillus thermarum
  ref <308>: DATABASE ACCESSION NUMBER: NCBI ACCESSION: NZ_AFCE01000211.1
  ref <309>: DATABASE ENTRY DATE: 2019-04-01
  ref <313>: RELEVANT RESIDUES IN SEQ ID NO: (1)..(1568)
tggagagtttgatcctggctcaggacgaacgctggcggcacgcctaatacatgcaagtcgagcgcgtgaagcttccagaagccttcgggcggacgggagtggatcgagcggcggacgggtgagtaacacgtaggcaacctgcctgtaagaccgggataaccccgggaaaccggggctaataccggataggaccttcggtcgcatgaccgttggttgaaaggtggccgcaaggctaccgcttacagatgggcctgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgcaagcctgacggagcgatgccgcgtgagcgaggaaggccttcgggtcgtaaagctctgttgtcagggaagaacaagtaccgttcgacaagggcggtaccttgacggtacctgacgagaaagccccggctaactacgtgccagcagccgcggtaatacgtagggggcgagcgttgtccggaatcactgggcgtaaagcgcgcgcaggcggcctcttaagtctggtgtgaaagcccgcggctcaaccgtggagacgcactggaaactgggaggcttgagtgcaggagagggaagcggaattcccggtgtagcggtgaaatgcgtagatatcgggaggaacaccagtggcgaaggcggcttcctggcctgtaactgacgctgaggcgcgaaagcgtggggagcaaacaggattagataccctggtagtccacgccgtaaacgatgagtgctaggtgttgggggtttcgacaccctcagtgctgaaggcaacccattaagcactccgcctggggagtacggccgcaaggctgaaactcaaaggaattgacgggggcccgcacaagcggtggagcatgtggtttaattcgaagcaacgcgaagaaccttaccagggcttgacatcccggtgctacctccagagatggagggttctcttcggagacaccggtgacaggtggtgcatggttgtcgtcagctcgtgtcgtgagatgttgggttaagtcccgcaacgagcgcaacccttggccttagttgccagcattcagttgggcactctaaggcgactgccggtgacaaaccggaggaaggtggggatgacgtcaaatcatcatgccccttatgccctgggctacacacgtgctacaatgggcggtacaaagggttgcgaacccgcgagggggagctaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaacccgcaagggagccagccgccgaaggtgggacagatgattggggtgaagtcgtaacaaggtatccctaccggaaggtggggatggatcacctcctttcta

SEQ ID NO: 2356 - DNA, 1598 bp, Caldanaerobacter subterraneus
  ref <308>: DATABASE ACCESSION NUMBER: NCBI ACCESSION: NZ_AXDC01000021.1
  ref <309>: DATABASE ENTRY DATE: 2019-04-01
  ref <313>: RELEVANT RESIDUES IN SEQ ID NO: (1)..(1598)
ctggagagtttgatcctggctcaggacgaacgctggcggcgtgcctaacacatgcaagtcgagcgggcctgtcaaggcgttatgttttggcaggttaagcggcggacgggtgagtaacgcgtgagcaacctacccttgagacagggataaccctgggaaaccggggctaatacctgatatactctattagggcatcctgatggaggaaagggcgggaagccgctcaaggatgggctcgcgtcccatcagctagttggtgaggtaacggctcaccaaggctacgacgggtagccggcctgagagggtggtcggccacactgggactgagacacggcccagactcctacgggaggcagcagtggggaatcttccgcaatgggcgaaagcctgacggagcgacgccgcgtgagcgaagaaggccttcgggtcgtaaagctcgatagtgtgggaagaaggaatgacggtaccacacgaaagccccggctaactacgtgccagcagccgcggtaagacgtagggggcgagcgttgtccggagttactgggcgtaaagggcgcgtaggcggtctagcaagtcaggtgtaaaagaccacggctcaaccgtggaggtgcacctgaaactgctaggctagagggcaggagaggggagtggaattcccggtgtagcggtgaaatgcgtagatatcgggaggaataccagtggcgaaggcgactccctggactggccctgacgctgaggcgcgagagcgtggggagcaaacaggattagataccctggtagtccacgctgtaaacgatgggtgctaggtgtggggagcggaagctttccgtgccgtaggaaacccaataagcaccccgcctggggagtacggccgcaaggctgaaactcaaaggaattgacgggggcccgcacaagcggtggagcatgtggtttaattcgaagcaacgcgaagaaccttaccagggcttgacatgcaggtagtagcgagccgaaaggtgagcgaccctctcttatgggagggagcctgcacaggtggtgcatggttgtcgtcagctcgtgtcgtgagatgttgggttaagtcccgcaacgagcgcaacccctgcctctagttgccagcgggtagatgccgggcactctagagggactgccgtcgataagacggaggaaggtggggatgacgtcaaatcatcatgccctttatgccctgggccacacacgtgctacaatggccggtacagcgggatgcgaagccgtgaggtggagccaatcccttaaagccggtctcagttcggattgcaggctgcaactcgcctgcatgaaggcggaatcgctagtaatcgcggatcagcatgccgcggtgaatacgttcccgggccttgtacacaccgcccgtcacaccacgggagccggcaacacccgaagccggacctcccaacccggcactcaagtgggcatgttagaaacgtgatgaagagaaaaaaacgtgcccacttgagtgccgggagggagccgtcgaaggtggggctggtgactggggtgaagtcgtaacaaggtagccgtacgggaacgtgcggctggatcacctcctttctaaggag

SEQ ID NO: 2357 - DNA, 217 bp, Caldanaerobius fijiensis
  ref <308>: DATABASE ACCESSION NUMBER: NCBI ACCESSION: NZ_FQVH01000017.1
  ref <309>: DATABASE ENTRY DATE: 2019-04-01
  ref <313>: RELEVANT RESIDUES IN SEQ ID NO: (1)..(217)
tattttacaagagagtttgatcctggctcaggacgaacgctggcggcgtgcctaacacatgcaagtcgagcggaggtagtggagcttgctcaactaccttagcggcggacgggggagtaacacgtgagcaacctgcctttaagaccgggataacacttcgaaagaggtgctaataccggataacatttatacaccgcatggtgtataaagaaagggg

SEQ ID NO: 2358 - DNA, 1486 bp, Caldanaerobius polysaccharolyticus
  ref <308>: DATABASE ACCESSION NUMBER: NCBI ACCESSION: NZ_KE386495.1
  ref <309>: DATABASE ENTRY DATE: 2019-04-01
  ref <313>: RELEVANT RESIDUES IN SEQ ID NO: (1)..(1486)
agagagtttgatcctggctcaggacgaacgctggcggcgtgcctaacacatgcaagtcgagcggaggtagtggagcttgctctgctaccttagcggcggacgggtgagtaacacgtgagcaacctgcctttaagaccgggataacacctcgaaaggggtgctaataccggataacatttacccatcgcatggtgggtaaagaaagggggtaacccgcttaaagaggggctcgcggcccatcagctagttggtgaggtaacggctcaccaaggcgacgacgggtagccggcctgagagggtgtacggccacactgggactgagacacggcccagactcctacgggaggcagcagtggggaatcttgcgcaatggggggaaccctgacgcagcgacgccgcgtgagcgaagaaggccttcgggttgtaaagctctgttatgtgggaaggagacggtaccacatgaggaagccccggccaactacgtgccagcagccgcggtaatacgtagggggcaagcgttgtccggagtgactgggcgtaaagggcgcgtaggcggttatacaagtcaggtgtaaaagataccggctcaaccggtaggtagcatctgatactgtataactagagtacaggagaggggagcggaattcctggtgtagcggtgaaatgcgtagagatcaggaagaacaccggtggcgaaggcggctctctggcctgggactgacgctgaggcgcgaaagcgtggggagcgaacaggattagataccctggtagtccacgctgtaaacgatggatactaggtgtgggtgagtaaaatcatccgtgccggagcaaacgcaataagtatcccgcctggggagtacggccgcaaggttgaaactcaaaggaattgacgggggcccgcacaagcagcggagcatgttgtttaattcgaagcaacgcgaagaaccttaccagggcttgacatccacagaatccggtggaaacactggagtgccccttatgggggagctgtgagacaggtggtgcatggttgtcgtcagctcgtgtcgtgagatgttgggttaagtcccgcaacgagcgcaacccctgcagctagttagagatctagctggactgccgtggatgacacggaggaaggtggggatgacgtcaaatcatcatgccccttatgccctgggctacaaacgtgctacaatggcgagtacagagggaagcgagggagcgatcctgagcgaatccgataaagctcgtcacagttcggattgcaggctgcaactcgcctgcatgaagtcggagttgctagtaatcgcggatcagcatgccgcggtgaatgcgttcccgggccttgtacacaccgcccgtcacaccacgagagtctacaatacccgaagacagggaagacctgttgaaggtagggtagatgattggggtgaagtcgtaacaaggtagccgtatcggaaggtgcggctggatcacctcctttcta

SEQ ID NO: 2359 - DNA, 414 bp, Caldanaerovirga acetigignens
  ref <308>: DATABASE ACCESSION NUMBER: NCBI ACCESSION: NZ_FRCR01000002.1
  ref <309>: DATABASE ENTRY DATE: 2019-04-01
  ref <313>: RELEVANT RESIDUES IN SEQ ID NO: (1)..(414)
cctgagagtttgatcctggctcaggacgaacgctggcggcgtgcctaacacatgcaagtcgagcgggggatgctgaaagctttgctggaagcatccttagcggcggacgggtgagtaacacgtaggcaacctacccaccacacggggatagccctgggaaaccgggggtaatacccgatgactttgctagccgcatggttagtaaagaaagctgccttttaggtggcggtggtggatgggcctgcggcccatcagctagttggtgaggtaacggctcaccaaggcgacgacgggtagccggcctgagagggtgtacggccacactgggactgggacacggcccagactcctacgggaggcagcagtggggaattttgggcaatggggggaaccctgacccagcgacgccgcgtg

SEQ ID NO: 2360 - DNA, 1559 bp, Caldibacillus debilis
  ref <308>: DATABASE ACCESSION NUMBER: NCBI ACCESSION: NZ_AZRV01000045.1
  ref <309>: DATABASE ENTRY DATE: 2019-04-01
  ref <313>: RELEVANT RESIDUES IN SEQ ID NO: (1)..(1559)
tggagagtttgatcctggctcaggacgaacgctggcggcgtgcctaatacatgcaagtcgagcggggcttgaggagggcttgcccttcgagagcccagcggcggacgggtgagtaacacgtgggtaacctgcccgtaagaccgggataactccgggaaaccggggctaataccggataacaccgggggccgcatggcttccggttgaaaggcggcctttggctgccacttacggatgggcccgcggcgcattagctagttggcggggtaacggcccaccaaggcgacgatgcgtagccggcctgagagggtggacggccacactgggactgagacacggcccagactcctacgggaggcagcagtagggaatcttccgcaatgggcgaaagcctgacggagcgacgccgcgtgagcgaggaaggccttcgggtcgtaaagctctgttgtcagggaagaaggcgcgccgttcgaagagggcggcgcggtgacggtacctgacgaggaagccccggctaactacgtgccaagcagccgcggtaaaaacgtagggggcgagcgttgtccggaattactgggcgtaaagcgcgcgcaggcggtcctttaagtctgatgtgaaattccgcggctcaaccgcgggtgtgcattggaaactgggggacttgagtgcggaagaggggagcggaattcccggtgtagcggtgaaatgcgtagagatcgggaggaacaccagtggcgaaggcggctctctggtccgcaactgacgctgaggcgcgaaagcgtggggagcgaacaggattagataccctggtagtccacgccgtaaacgatgagtgctaagtgttagaggggattgaccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtctggagacaggcctttcccttatgggacagcggtgacaggtggtgcatggttgtcgtcagctcgtgtcgtgagatgttgggttaagtcccgcaacgagcgcaacccctgtccttagttgccagcattgagttgggcactctaaggagactgccggctagaagtcggaggaaggtggggatgacgtcaaatcatcatgccccttatgacctgggctacacacgtgctacaatgggcggtacaaagggcagcgaaccgcgagggggagcggaatcccaaaaagccgctctcagttcggattgcaggctgcaactcgcctgcatgaaggcggaatcgctagtaatcgcggatcagcatgccgcggtgaatacgttctcgggccttgtacacaccgcccgtcacaccacgagagtctgcaacacccgaagtcggtgaggtaacccgaaagggagccagccgccgaaggtggggcagatgattggggtgaagtcgtaacaaggtagccgtatcggaaggtgcggctggatcacctcctttcta

SEQ ID NO: 2361 - DNA, 1267 bp, Caldicellulosiruptor acetigenus
  ref <308>: DATABASE ACCESSION NUMBER: NCBI ACCESSION: NZ_ATXO01000007.1
  ref <309>: DATABASE ENTRY DATE: 2019-04-01
  ref <313>: RELEVANT RESIDUES IN SEQ ID NO: (1)..(1267)
tttgagagtttgatcctggctcaggacgaacgctggcggcgtgcctaacgcatgcaagtcgagcggagatggtagctgaaggtgatgagctggaagctatcatcttagcggcggacgggtgagtaacacgtgagcaacctaccctcagcacggggataacagctcgaaagggctgctaatacccgatgggaccacggcatcgcatggtgctgtggtgaaagggtagccggagaggctataccggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcgaaagcctgacgcagcgacgccgcgtgagggaagaagcccttcggggtgtaaacctctttggacggggagaagaggaagatagtacccgtttaaaaagccacggctaactacgtgccagcagccgcggtaatacgtaggtggcgagcgttgtccggaattactgggcgtaaagggtgcgtaggcggcctggtaagttgagcgtgaaatttttgggctcaacccaaaaggagcgctcaagactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaagaactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccgggaaccctgccgaaaggtgggggtgcctgaccgtaaggttaggagcccggacacaggtggtgcatggttgtcgtcagctcgtgtcgtgagatgttgggttaagtcccgcaacgagcgcaacccctgcccttagttgccagcggttttaggcgggcactctaaggggactgccgccgatgaggcggaggaaggtggggatgacgtcaaatcatcatgccccttatgccctgggctacacacgtgctacaatgggtgctacagagggc

SEQ ID NO: 2362 - DNA, 1536 bp, Caldicellulosiruptor changbaiensis
  ref <308>: DATABASE ACCESSION NUMBER: NCBI ACCESSION: NZ_CP034791.1
  ref <309>: DATABASE ENTRY DATE: 2019-04-01
  ref <313>: RELEVANT RESIDUES IN SEQ ID NO: (1)..(1536)
tttattgagagtttgatcctggctcaggacgaacgctggcggcgtgcctaacgcatgcaagtcgagcggaggtagctatgaaggtgaagagcctaagtagctaccttagcggcggacgggtgagtaacacgtgagcaacctacccccagcacggggataacagctcgaaagggctgctaatacccgatgggaccacggcatcgcatgatgttgtggtgaaaggagtaatccggctggggatgggctcgcggcccatcagctagttggtgaggtaacggctcaccaaggcgacgacgggtagccggcctgagagggtgtacggccacagtgggactgagacacggcccacactcctacgggaggcagcagcggggaatcttgcgcaatgggcggaagcctgacgcagcgacgccgcgtgagggaggaagcccttcggggtgtaaacctctttggacggggagaaggaggagatagtacccgtttaaaaagccacggctaactacgtgccagcagccgcggtaatacgtaggtggcgagcgttgtccggaattactgggcgtaaagggtgcgtaggcggctatgcaagttaagcgtgaaagccttaggctcaacctaaggattgcgcttaatactgcatagcttgagtgcgggagaggacggcggaattcccggtgtagcggtgaaatgcgtagatatcgggaggaacaccagtggcgaaggcggccgtctggaccgtaactgacgctgaggcacgaaagcgtggggagcgaacaggattagataccctggtagtccacgctgtaaacgatggatgctaggtgtgggggagaaggactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccgggaacctgcccgaaagggtggggtgcctgaccgtaaggttaggagcccggacacaggtggtgcatggttgtcgtcagctcgtgtcgtgagatgttgggttaagtcccgcaacgagcgcaacccctgcccttagttgccagcgcgtaatggtgggcactctaaggggactgccgtcgatgaggcggaggaaggtggggatgacgtcaaatcatcatgccccttatgccctgggctacacacgtgctacaatgggtgctacagagggcgtgcgaaggcgcgagccggagcgaatcccaaaaaagcaccctcagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacagggcagctgtgttgaaggtggggctgatgattggggtgaagtcgtaacaaggtagccgtacgggaacgtgcggctggatcacctcctttctaagg

SEQ ID NO: 2363 - DNA, 1540 bp, Caldicellulosiruptor danielii
  ref <308>: DATABASE ACCESSION NUMBER: NCBI ACCESSION: NZ_LACM01000001.1
  ref <309>: DATABASE ENTRY DATE: 2019-04-01
  ref <313>: RELEVANT RESIDUES IN SEQ ID NO: (1)..(1540)
ttgagagtttgatcctggctcaggacgaacgctggcggcgtgcctaacgcatgcaagtcgagcggaggtagctatgaaggtgatgagctggagtggctaccttagcggcggacgggtgagtaacacgtgagcaacctaccctcagcacggggataacagctcgaaagggctgctaatacccgatgggaccacggcatcgcatgatgttgtggtgaaagggtagcttttgaggctataccggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcgaaagcctgacgcagcgacgccgcgtgagggaaggagcccttcggggtgtaaacctctttggacggggagaagtagaagatagtacccgtttaaaaagccacggctaactacgtgccagcagccgcggtaatacgtaggtggcgagcgttgtccggaattactgggcgtaaagggtgcgtaggcggcctggtaagttgagcgtgaaatttttgggctcaacccaaaaggagcgctcgatactgctgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaaggactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccggggacctgcccgaaagggtggggtgcctgcgcggtaagtgcaggagcctggacacaggtggtgcatggttgtcgtcagctcgtgtcgtgagatgttgggttaagtcccgcaacgagcgcaacccctgcccttagttgccagcgcgtagaggcgggcactctaaggggactgccgccgatgaggcggaggaaggtggggatgacgtcaaatcatcatgccccttatgccctgggctacacacgtgctacaatgggtgctacagagggttgcgaaggcgcgagccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacaggatggctgtgttgaaggtggggctgatgattggggtgaagtcgtaacaaggtagccgtacgggaacgtgcggctggatcacctcctttct

SEQ ID NO: 2364 - DNA, 1543 bp, Caldicellulosiruptor hydrothermalis
  ref <308>: DATABASE ACCESSION NUMBER: NCBI ACCESSION: NC_014652.1
  ref <309>: DATABASE ENTRY DATE: 2019-04-01
  ref <313>: RELEVANT RESIDUES IN SEQ ID NO: (1)..(1543)
tttgagagtttgatcctggctcaggacgaacgctggcggcgtgcctaacgcatgcaagtcgagcggagatggtggttgaaggtgatgagctggaggctgccatcttagcggcggacgggtgagtaacacgtgagcaacctaccctcagcacggggataacagctcgaaagggctgctaatacccgatgggaccacggcatcgcatggtgttgtggtgaaagggtggatattgaggtccataccggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcgaaagcctgacgcagcgacgccgcgtgagggaaggagcccttcggggtgtaaacctctttggacggggagaaggtgaagatagtacccgtttaaaaagccacggctaactacgtgccagcagccgcggtaatacgtaggtggcgagcgttgtccggaattactgggcgtaaagggtgcgtaggcggcctggtaagttgagcgtgaaatttttgggctcaacccaaaaggagcgttcaaaactgccaggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaagaactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccggggacctgcccgaaagggtggggtgcctgaccgtaaggttaggagcctggacacaggtggtgcatggttgtcgtcagctcgtgtcgtgagatgttgggttaagtcccgcaacgagcgcaacccctgcccttagttgccagcgcgtagaggcgggcactctaaggggactgccgccgatgaggcggaggaaggtggggatgacgtcaaatcatcatgccccttatgccctgggctacacacgtgctacaatgggtgctacagagggcagcgaaggcgcgagccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacagggcagctgtgttgaaggtggggctgatgattggggtgaagtcgtaacaaggtagccgtacgggaacgtgcggctggatcacctcctttct

SEQ ID NO: 2365 - DNA, 1547 bp, Caldicellulosiruptor kristjanssonii
  ref <308>: DATABASE ACCESSION NUMBER: NCBI ACCESSION: NC_014721.1
  ref <309>: DATABASE ENTRY DATE: 2019-04-01
  ref <313>: RELEVANT RESIDUES IN SEQ ID NO: (1)..(1547)
tttgagagtttgatcctggctcaggacgaacgctggcggcgtgcctaacgcatgcaagtcgagcggagatggtagctgaaggtgatgagctggaagctatcatcttagcggcggacgggtgagtaacacgtgagcaacctaccctcagcacggggataacagctcgaaagggctgctaatacccgatgggaccacggcatcgcatggtgttgtggtgaaagggtagccgaagaggctatgccggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcgaaagcctgacgcagcgacgccgcgtgagggaagaagcccttcggggtgtaaacctctttggacggggagaagtggaagatagtacccgtttaaaaagccacggctaactacgtgccagcagccgcggtaatacgtaggtggcgagcgttgtccggaattactgggcgtaaagggtgcgtaggcggcctggtaagttgagcgtgaaatttttgggctcaacccaaaaggagcgctcaagactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaagaactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgcggggaaccctgccgaaaggcgggggtgcctgcttgttaagagcaggagcccggacacaggtggtgcatggttgtcgtcagctcgtgtcgtgagatgttgggttaagtcccgcaacgagcgcaacccctgcccttagttgccagcggttttagccgggcactctaaggggactgccgccgatgaggcggaggaaggtggggatgacgtcaaatcatcatgccccttatgccctgggctacacacgtgctacaatgggtgctacagagggcggcgaaggcgcgagccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacaggatatctgtgttgaaggtggggctgatgattggggtgaagtcgtaacaaggtagccgtacgggaacgtgcggctggatcacctcctttctaagg

SEQ ID NO: 2366 - DNA, 1549 bp, Caldicellulosiruptor kronotskyensis
  ref <308>: DATABASE ACCESSION NUMBER: NCBI ACCESSION: NC_014720.1
  ref <309>: DATABASE ENTRY DATE: 2019-04-01
  ref <313>: RELEVANT RESIDUES IN SEQ ID NO: (1)..(1549)
atttgagagtttgatcctggctcaggacgaacgctggcggcgtgcctaacgcatgcaagtcgagcggagatggtggttgaaggtgatgagctggaggctgccatcttagcggcggacgggtgagtaacacgtgagcaacctaccctcagcacggggataacagctcgaaagggctgctaatacccgatgggaccacggcatcgcatgatgttgtggtgaaagggtggatgtaaggtccattccggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcgaaagcctgacgcagcgacgccgcgtgagggaagaagcccttcggggtgtaaacctctttggacggggagaaggagaagatagtacccgtttaaaaagccacggctaactacgtgccagcagccgcggtaatacgtaggtggcgagcgttgtccggaattactgggcgtaaagggtgcgtaggcggcctggtaagttgagcgtgaaatttttgggctcaacccaaaaggagcgttcaaaactgccaggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaagaactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccggggaccctgccgaaaggtaggggtgcctgcttgttgagagcaggagcccggacacaggtggtgcatggttgtcgtcagctcgtgtcgtgagatgttgggttaagtcccgcaacgagcgcaacccctgcccttagttgccagcacgtaaaggtgggcactctaaggggactgccgccgatgaggcggaggaaggtggggatgacgtcaaatcatcatgccccttatgccctgggctacacacgtgctacaatgggtgctacagagggcagcgaaggcgtgagccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacaggttaagctgtgttgaaggtggggctgatgattggggtgaagtcgtaacaaggtagccgtacgggaacgtgcggctggatcacctcctttctaagg

SEQ ID NO: 2367 - DNA, 1547 bp, Caldicellulosiruptor lactoaceticus
  ref <308>: DATABASE ACCESSION NUMBER: NCBI ACCESSION: NC_015949.1
  ref <309>: DATABASE ENTRY DATE: 2019-04-01
  ref <313>: RELEVANT RESIDUES IN SEQ ID NO: (1)..(1547)
tttgagagtttgatcctggctcaggacgaacgctggcggcgtgcctaacgcatgcaagtcgagcggagatggtagctgaaggtgatgagctggaagctatcatcttagcggcggacgggtgagtaacacgtgagcaacctaccctcagcacggggataacagctcgaaagggctgctaatacccgatgggaccacggcatcgcatggtgctgtggtgaaagggtagccggagaggctatgccggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcgaaagcctgacgcagcgacgccgcgtgagggaagaagcccttcggggtgtaaacctctttggacggggagaagtggaagatagtacccgtttaaaaagccacggctaactacgtgccagcagccgcggtaatacgtaggtggcgagcgttgtccggaattactgggcgtaaagggtgcgtaggcggcctggtaagttgagcgtgaaatttttgggctcaacccaaaaggagcgctcaagactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaagaactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccgggaaccctgccgaaaggcgggggtgcctgcatgatgagtgcaggagcccggacacaggtggtgcatggttgtcgtcagctcgtgtcgtgagatgttgggttaagtcccgcaacgagcgcaacccttgcccttagttgccagcggttttagccgggcactctaaggggactgccgccgatgaggcggaggaaggtggggatgacgtcaaatcatcatgccccttatgccctgggctacacacgtgctacaatgggtgctacagagggcagcgaaggggcgacccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacaggatatctgtgttgaaggtggggctgatgattggggtgaagtcgtaacaaggtagccgtacgggaacgtgcggctggatcacctcctttctaagg

SEQ ID NO: 2368 - DNA, 1529 bp, Caldicellulosiruptor morganii
  ref <308>: DATABASE ACCESSION NUMBER: NCBI ACCESSION: NZ_LACO01000001.1
  ref <309>: DATABASE ENTRY DATE: 2019-04-01
  ref <313>: RELEVANT RESIDUES IN SEQ ID NO: (1)..(1529)
tttgagagtttgatcttggctcaggacgaacgctggcggcgtgcctaacgcatgcaagtcgagcggaggtagctatgaagggtaaccggattagctaccttagcggcggacgggtgagtaacacgtgagtaacctgcccccagcacggggataacagctcgaaagggctgctaatacccgataggaccacggcatcgcatgatgctgtggtgaaaggaggaatccggctggggatgggctcgcggcccatcagctagttggtggggtaacggcccaccaaggctacgacgggtagccggcctgagagggtggtcggccacagtgggactgagacacggcccacactcctacgggaggcagcagcggggaatcttgcgcaatgggcgaaagcctgacgcagcgacgccgcgtgagggaggaagcccttcggggtgtaaacctctttggacggggagaaggtgaagatagtacccgtttaaaaagccacggctaactacgtgccagcagccgcggtaatacgtaggtggcgagcgttgtccggaattactgggcgtaaagggtgcgtaggcggctgggtaagttaagcgtgaaatcctggggctcaaccctggggctgcgcttaatactgcctggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaaggactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccgggaacctgcccgaaagggtggggtgcctgcttttatgagcaggagcccggacacaggtggtgcatggttgtcgtcagctcgtgtcgtgagatgttgggttaagtcccgcaacgagcgcaacccctgcccttagttgccagcgggtgaagccgggcactctaaggggactgccgtcgatgaggcgaaggaaggtggggatgacgtcaaatcatcatgccccttatgccctgggctacacacgtgctacaatgggtgctacagagggatgcgaaggcgcgagctggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacgcgggtagcgtgttgaaggtggggctgatgattggggtgaagtcgtaacaaggtagccgtacgggaacgtgcggctggatcacctcctttctaagg

SEQ ID NO: 2369 - DNA, 1550 bp, Caldicellulosiruptor naganoensis
  ref <308>: DATABASE ACCESSION NUMBER: NCBI ACCESSION: NZ_LACN01000012.1
  ref <309>: DATABASE ENTRY DATE: 2019-04-01
  ref <313>: RELEVANT RESIDUES IN SEQ ID NO: (1)..(1550)
ttgattgagagtttgatcctggctcaggacgaacgctggcggcgtgcctaacgcatgcaagtcgagcggggatggtggttgaaggtgatgagctggaggctgccatcttagcggcggacgggtgagtaacacgtgagtaacctacccccagcacggggataacagctcgaaagggctgctaatacccgatgggaccacggcatcgcatgatgctgtggtgaaagggtagccggtgaggctattccggctggggatgggctcgcggcccatcagctagttggtggggtaatggcccaccaaggctacgacgggtagccggcctgagagggtggtcggccacagtgggactgagacacggcccacactcctacgggaggcagcagcggggaatcttgcgcaatgggcgaaagcctgacgcagcgacgccgcgtgagggaggaagcccttcggggtgtaaacctctttggacggggagaagtaggagatagtacccgtttaaaaagccacggctaactacgtgccagcagccgcggtaatacgtaggtggcgagcgttgtccggaattactgggcgtaaagggtgcgtaggcggctgggtaagttaagcgtgaaatcttggggctcaaccccaaggctgcgcttaatactgctcggctagagtacgggagaggacggcggaattcccggtgtagcggtgaaatgcgtagatatcgggaggaacaccagtggcgaaggcggccgtctggaccgttactgacgctgaggcacgaaagcgtggggagcaaacaggattagataccctggtagtccacgctgtaaacgatggatgctaggtgtgggggagaaggactcctccgtgccgtagttaacacattaagcatcccgcctggggagtacggccgcaaggttgaaactcaaaggaattgacgggggcccgcacaagcggtggagcatgtggtttaattcgaagcaacgcgaagaaccttaccagggcttgacatgccgggaaccctgccgaaaggtgggggtgcctgcgcgatgagtgcaggaacccggacacaggtggtgcatggttgtcgtcagctcgtgtcgtgagatgttgggttaagtcccgcaacgagcgcaacccctgcccttagttgccagcgggtaatgccgggcactctaaggggactgccgtcgatgaggcggaggaaggtggggatgacgtcaaatcatcatgccctttatgccctgggctacacacgtgctacaatgggtgctacagagggttgcgaaggcgcgagccggagctaatcccaaaaaagcacccccagttcggattgcaggctgcaactcgcctgcatgaagccggaatcgctagtaatcgcggatcagcatgccgcggtgaatacgttcccgggccttgtacacaccgcccgtcacaccatgagagtcagcaacacctgaagacacgctgtgagcgtgttgaaggtggggctgatgattggggtgaagtcgtaacaaggtagccgtacgggaacgtgcggctggatcacctcctttctaagg

SEQ ID NO: 2370 - DNA, 1553 bp, Caldicellulosiruptor obsidiansis
  ref <308>: DATABASE ACCESSION NUMBER: NCBI ACCESSION: NC_014392.1
  ref <309>: DATABASE ENTRY DATE: 2019-04-01
  ref <313>: RELEVANT RESIDUES IN SEQ ID NO: (1)..(1553)
ttaattgagagtttgatcctggctcaggacgaacgctggcggcgtgcctaacgcatgcaagtcgagcggggatgctaagtggagagggggaactcttgaagcttagcatcttagcggcggacgggtgagtaacacgtgagcaacctaccctcagcacggggataacagctcgaaagggctgctaatacccgatgggaccacgtcatcgcatggtgatgtggtgaaagggtagccggagaggctataccggctggggatgggctcgcggcccatcagctagttggtggggtaacggcctaccaaggcgacgacgggtagccggcctgagagggtgaccggccacagtgggactgagacacggcccacactcctacgggaggcagcagcggggaatcttgcgcaatgggcgaaagcctgacgcagcgacgccgcgtgagggaaggagcccttcggggtgtaaacctctttggacggggagaagtaggagatagtacccgtttaaaaagccacggctaactacgtgccagcagccgcggtaatacgtaggtggcgagcgttgtccggaattactgggcgtaaagggtgcgtaggcggcctggtaagttgagcgtgaaatttttgggctcaacccaaaaggagcgttcaagactgccaggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaagaactcttccgtgccggagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccggggacctgcccgaaagggtggggtgcctgaccgatgaggttaggaacccggacacaggtggtgcatggttgtcgtcagctcgtgtcgtgagatgttgggttaagtcccgcaacgagcgcaacccctgcccttagttgccagcgggcagagccgggcactctaaggggactgccgccgatgaggcggaggaaggtggggatgacgtcaaatcatcatgccccttatgccctgggctacacacgtgctacaatgggtgctacagagggcagcgaaggcgcgagccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacagggcatctgtgttgaaggtggggctgatgattggggtgaagtcgtaacaaggtagccgtacgggaacgtgcggctggatcacctcctttctaagg

SEQ ID NO: 2371 - DNA, 1550 bp, Caldicellulosiruptor owensensis
  ref <308>: DATABASE ACCESSION NUMBER: NCBI ACCESSION: NC_014657.1
  ref <309>: DATABASE ENTRY DATE: 2019-04-01
  ref <313>: RELEVANT RESIDUES IN SEQ ID NO: (1)..(1550)
attgagagtttgatcctggctcaggacgaacgctggcggcgtgcctaacgcatgcaagtcgagcggggatgctaagcggatgggggaaactcttgaagcttagcatcttagcggcggacgggtgagtaacacgtgagcaacctgccctcagcacggggataacagctcgaaagggctgctaatacccgatgggaccacggcatcgcatgatgttgtggtgaaagggtggacgtaatgttcataccggctggggatgggctcgcggcccatcagctagttggtggggtaacggcctaccaaggcgacgacgggtagccggcctgagagggtgaccggccacagtgggactgagacacggcccacactcctacgggaggcagcagcggggaatcttgcgcaatgggcgaaagcctgacgcagcgacgccgcgtgagggaaggagcccttcggggtgtaaacctctttggacggggagaagtagaagatagtacccgtttaaaaagccacggctaactacgtgccagcagccgcggtaatacgtaggtggcgagcgttgtccggaattactgggcgtaaagggtgcgtaggcggtctggtaagttgagcgtgaaatttttgggctcaacccaaaaggagcgttcaagactgccaggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacaggattagataccctggtagtccacgctgtaaacgatggatgctaggtgtgggggagaaggactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccgggaacccttccgaaaggagggggtgcctgaccgtaaggttaggagcccggacacaggtggtgcatggttgtcgtcagctcgtgtcgtgagatgttgggttaagtcccgcaacgagcgcaacccctgcccttagttgccagcgggtgaagccgggcactctaaggggactgccgccgatgaggcggaggaaggtggggatgacgtcaaatcatcatgccccttatgccctgggctacacacgtgctacaatgggtgctacagagggcgagcgaaggcgcgagccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacagggtagctgtgttgaaggtggggctgatgattggggtgaagtcgtaacaaggtagccgtacgggaacgtgcggctggatcacctcctttctaagg

SEQ ID NO: 2372 - DNA, 1552 bp, Caldicellulosiruptor saccharolyticus
  ref <308>: DATABASE ACCESSION NUMBER: NCBI ACCESSION: NC_009437.1
  ref <309>: DATABASE ENTRY DATE: 2019-04-01
  ref <313>: RELEVANT RESIDUES IN SEQ ID NO: (1)..(1552)
ttaattgagagtttgatcctggctcaggacgaacgctggcggcgtgcctaacgcatgcaagtcgagcggagatggtggttgaaggtgatgagctggaggctgccatcttagcggcggacgggtgagtaacacgtgagcaacctacccccagcacggggataacagctcgaaagggctgctaatacccgatgggaccacgtcatcgcatggtgatgtggtgaaagggtagccggggaggctatactggctggggatgggctcgcggcccatcagctagttggtggggtaacggcctaccaaggcgacgacgggtagccggcctgagagggtgtacggccacagtgggactgagacacggcccacactcctacgggaggcagcagcggggaatcttgcgcaatgggcggaagcctgacgcagcgacgccgcgtgagggaagaagcccttcggggtgtaaacctctttggacggggagaagtaggagatagtacccgtttaaaaagccacggctaactacgtgccagcagccgcggtaatacgtaggtggcgagcgttgtccggaattactgggcgtaaagggtgcgtaggcggctatgcgagttaagcgtgaaagccttaggctcaacctaaggattgcgcttaatactgcatagcttgagtgcgggagaggacggcggaattcccggtgtagcggtgaaatgcgtagatatcgggaggaacaccagtggcgaaggcggccgtctggaccgtaactgacgctgaggcacgaaagcgtggggagcgaacaggattagataccctggtagtccacgctgtaaacgatggatgctaggtgtgggggagaaggactcttccgtgccgtagttaacacaataagcatcccgcctggggagtacggccgcaaggttgaaactcaaaggaattgacgggggcccgcacaagcggtggagcatgtggtttaattcgaagcaacgcgaagaaccttaccagggcttgacatgccggggacctgcccgaaagggtggggtgcctgttcgatgagagcaggagcccggacacaggtggtgcatggttgtcgtcagctcgtgtcgtgagatgttgggttaagtcccgcaacgagcgcaacccctgcccttagttgccagcgcgtaatggtgggcactctaaggggactgccgtcgatgaggcggaggaaggtggggatgacgtcaaatcatcatgccccttatgccctgggctacacacgtgctacaatgggtgctacagagggcgtgcgaaggcgcgagccggagcgaatcccaaaaaagcacccccagttcggattgcaggctgcaactcgcctgcatgaagtcggaatcgctagtaatcgcggatcagcatgccgcggtgaatacgttcccgggccttgtacacaccgcccgtcacaccatgagagtcagcaacacctgaagacacaggttaagctgtgttgaaggtggggctgatgattggggtgaagtcgtaacaaggtagccgtacgggaacgtgcggctggatcacctcctttctaagg

SEQ ID NO: 2373 - DNA, 896 bp, Caldicoprobacter oshimai
  ref <308>: DATABASE ACCESSION NUMBER: NCBI ACCESSION: NZ_JAGB01000004.1
  ref <309>: DATABASE ENTRY DATE: 2019-04-01
  ref <313>: RELEVANT RESIDUES IN SEQ ID NO: (1)..(896)
ggaattcctggtgtagcggtgaaatgcgtagatatcaggaggaacaccagtggcgaaggcggcttcctggcctgtaactgacgctgaggcacgaaagcgtggggagcaaacaggattagataccctggtagtccacgctgtaaacgatggatactaggtgtagggggcgattgagccttctgtgccgaagttaacgcaataagtatcccgcctggggagtacggccgcaaggttgaaactcaaaggaattgacgggggcccgcacaagcggtggagcatgtggtttaattcgaagcaacgcgaagaaccttaccagggcttgacatgcccctgaagtatctggaaacaggtacggcctatgccttcgggtataggacaggggacacaggtggtgcatggttgtcgtcagctcgtgtcgtgagatgttgggttaagtcccgcaacgagcgcaacccttatccctagttgccagcgcgttatggcggggactctagggagactgccggggagaactcggaggaaggtggggatgacgtcaaatcatcatgccccttatgccctgggctacacacgtgctacaatggccaggtacagagggaggcgaagcggtaacgcggagcgaatcccaaaaagctggtctcagttcggattgtgggctgcaactcgcccacatgaagtcggaatcgctagtaatcgcggatcagcatgccgcggtgaatacgttcccgggccttgtacacaccgcccgtcacaccatgggagttgggggcacccgaagccggtggcctaacccggaaagggagggagccgtcgaaggtgaacccaatgactggggtgaagtcgtaacaaggtagccgtatcggaaggtgcggctggatcacctcctttctaaggag

SEQ ID NO: 2374 - DNA, 1571 bp, Caldimicrobium thiodismutans
  ref <308>: DATABASE ACCESSION NUMBER: NCBI ACCESSION: NZ_AP014945.1
  ref <309>: DATABASE ENTRY DATE: 2019-04-01
  ref <313>: RELEVANT RESIDUES IN SEQ ID NO: (1)..(1571)
ccctgagggtttgatcctggctcagggcgaacgctagcggcgcgcctaacacatgcaagtcgtgcgggaaagggctccggcccaagtaccgcggcagacgggtgagtaacacgtgagtaacctgtcctcaggtctgggataaccatccgaaagggtggctaataccggataaagtcactgggcgcaagttcagtgatgaaaggaggcctctgcatagcaagcttctgcctgaggaggggctcgcggcccatcagcttgttggtggggtaatggcccaccaaggctatgacgggtagccggcctgagagggtggtcggccacacgggcactgagacacgggcccgactcctacgggaggcagcagtggggaatcttgggcaatgggcgaaagcctgacccagcgacgccgcgtgggggacgaaggccttcgggtcgtaaacccctgttctgggggaagaaccaggtcgtagcgaatagctatggcctgctgacggtaccccaggagaaagccacggctaactgcgtgccagcagccgcggtaatacgcaggtggcaagcgttgcccggaatcactgggcgtaaagggtgcgtaggcggcaaggcaagtcgcaggtcaaagcccggggctcaaccccggaagggcctgcgatactgttttgcttgagggccggagaggctggcggaattcccggtgtaggggtgaaatccgtagatatcgggaggaacaccggtggggaagcctgccagctggacggttcctgacgctgaggcacgaaagcgtggggagcaaaccggattagatacccgggtagtccacgccgtaaacgatgggtgctaggtctggggaggaaactctctgggccgcagctaacgcgttaagcaccccgcctggggagtacggccgcaaggctgaaactcaaaggaattgacgggggcccgcacaagcggtggagcacgtggtttaattcgatgcaaagcgaagaaccttacctgggtttgacatgccagggttgtaccccgatagaaatattgggggagtgtggggttttcctcgcacgctctggcacaggtgctgcatggctgtcgtcagctcgtgtcgtgagatgttgggttaagtcccgcaacgagcgcaacccctgcccttagttgccagcgggtaagccgggcactctaaggggactgctggggataacccggaggaaggaggggatgacgtcaagtcctcatggcccttatgcccagggctacacacgtgctacaatggggggtacagagggttgcaaacccgcaagggggagctaatcccagaaagccctcctcagttcggatcggggtctgcaactcgaccccgtgaagccggaatcgctagtaatggcggatcagcatgccgccgtgaatgcgttcccgggccttgtacacaccgcccgtcacaccacggaagccggtctcacccgaagtcgctatctcaacccggctcgccgggagggaggcgcctacggtggggctggtgactggggtgaagtcgtaacaaggtacccctaccggaaggtgggggtggatcacctcctttc

SEQ ID NO: 2375 - DNA, 1239 bp, Caldisalinibacter kiritimatiensis
  ref <308>: DATABASE ACCESSION NUMBER: NCBI ACCESSION: NZ_ARZA01000024.1
  ref <309>: DATABASE ENTRY DATE: 2019-04-01
  ref <313>: RELEVANT RESIDUES IN SEQ ID NO: (1)..(1239)
ttcaatttgagagtttgatcctggctcaggacgaacgctggcggcgtgcctaacacatgcaagtcgagcgaagcttacctcatgattccttcgggttgattgagactaagcttagcggcagacgggtgagtaacgcgtgagaaacctgccctacacagggggatagcctcgggaaaccgggattaataccccataaaactctagtagcgcatgctacatgggtcaaaactccggtggtgtaggatggtctcgcgtcccattagctagttggtgaggtaacggctcaccaaggcgacgatgggtagccggcctgagagggtgaacggccacactggaactgagacacggtccagactcctacgggaggcagcagtggggaatattgcacaatgggggaaaccctgatgcagcgacgccgcgtgagcgatgaaggccttcgggtcgtaaagctctgtcctaagggaagaattttgacggtaccttaggaggaagccccggctaactacgtgccagcagccgcggtaatacgtagggggcgagcgttgtccggaattactgggcgtaaagggtgcgtaggcggccctgcaagtcaggtgtgaaagccctcggctcaaccgaggtaagcacttgaaactgtagggcttgagtgcaggagaggagagcggaatttctagtgtagcggtgaaatgcgtagatattagaaggaacaccagtggcgaaggcggctctctggactgcaactgacgctgaggcacgaaagcgtggggagcgaacaggattagataccctggtagtccacgccgtaaacgatgagcgctaggtgtcggggtcgccagacttcggtgctgcagctaacgcattaagcgctccgcctggggagtacggtcgcaagactgaaactcaaaggaattgacgggggcccgcacaagcagcggagcatgtggtttaattcgaagcaacgcgaagaaccttaccagggcttgacatccctcggaccgtcctagagataggactttcccttcggggactgaggtgacaggtggtgcatggttgtcgtcagctcgtgtcgtgagatgttgggttaagtcccgcaacgagcgcaacccttgcctttagttgccatcaggtaatgctgggcactctagagggactgccggtgacaaaccggaggaaggtggggatgacgtcaaatcatcatgccccttatgccctgggctacacacgtgctacaatggccgg

SEQ ID NO: 2376 - DNA, 1562 bp, Caldisericum exile
  ref <308>: DATABASE ACCESSION NUMBER: NCBI ACCESSION: NC_017096.1
  ref <309>: DATABASE ENTRY DATE: 2019-04-01
  ref <313>: RELEVANT RESIDUES IN SEQ ID NO: (1)..(1562)
attttttcggagagtttgatcctggctcaggatgaacgctggcggcgtgccttacacatgcaagtcgagcggagaagatttcctgtggcaacacaggagtcttcttagcggcaaacgggtgagtaatggatgagtaacctgccctgtagacggggatagccatccgaaaggatgggtaatacccgataatgttggaggacttcggttctccaaagaaaggtggcgcaagctaccgcttcaggatgggctcatctcctatcagctagttggtgaggtaatggctcaccaaggctatgacgggtagctggcctgagagggtggtcagccacattgggactgagacacggcccagactcctacgggaggcagcagtggggaatcttggtcaatgggcgaaagcctgaaccagcgacgccgcgtggaggacgaaggccgaaaggtcgtaaactccttttgcaagggaaaaagggaggggttcgaatagggccctatccttgatggtaccttgcgaataagccccagccaactacgtgccagcagctgcggtaaaacgtagggggcgagcgttatccggaatcactgggtgtaaagggtacgcaggcggacttgtaagttggatgtaaaaactcagggctcaaccttgagcttgcattcaatactacaagtctagagagcaggagaggggagtggaattcccggtgtaggggtaaaatccgtagatatcgggaggaacaccagtggcgaaggcggctccctggcctgtctctgacgctcaggtacgaaagcgtggggagcaaacaggattagataccctggtagtccacgccctaaacgatgggtgcttggtgttggggggtaattccctcagtgccgtagctaacgcgttaagcaccccacctggggagtacggccgcaaggttgaaactcaaaggaattgacggggacccgcacaagcagcgaggcatgtggtttaattcgatgctacacgaagaaccttacctgggcttgacatgcatgtgaaagcctgaagaaactcgggcccccataggggttacaccctatggcacatgcacaggtgctgcatggttgtcgtcagctcgtgtcgtgagatgtacggttaagtccgtgaacgagcgcaacccctgcccttagttgctaataggcttcggcctatgcactctaaggggactgccagcgataagctggaggaaggtggggatgacgtcaaatcctcatggcccttatgcccagggctacacacatgcgacaatggtcgggacaatgcgttgcaaaccagtaatggggagctaatcgcaaaaaaccgaccccagtacggattgagggttgcaactcaccctcatgaagctggagttgctagtaaccgccggtcagctatacggcgatgaatacgttcccgggtcttgtacacaccgcccgtcacaccacccgagttgcgtgcacccgaagtggctcggtgagtcacgaaggtgtgcgtgatgaggagggtgaagtcgtaacaaggtaggtgtacgagaacgtgcgcctggatcacctcctttcta

SEQ ID NO: 2377 - DNA, 1570 bp, Calditerricola satsumensis
  ref <308>: DATABASE ACCESSION NUMBER: NCBI ACCESSION: NZ_BBCF01000382.1
  ref <309>: DATABASE ENTRY DATE: 2019-04-01
  ref <313>: RELEVANT RESIDUES IN SEQ ID NO: (1)..(1570)
tggagagtttgatcctggctcaggacgaacgctggcggcgcgcctaatacatgcaagtcgagcggggcttttcgcgtgaagccttcgggcggatcgcggggagcctagcggcgaacgggtgcgtaacacgtgggcaacctaccccgaggaccgggataactccgggaaaccggggctaataccggataggacggcggaccgcatggtccgcgtggaaaggcggcgcaagctgccacctcgggatgggcccgcggcccattagcttgttggtggggtaacggcccaccaaggcgacgatgggtagccggcctgagagggtgaccggccacactgggactgagacacggcccagactcctacgggaggcagcagtagggaatcttccgcaatgggcgaaagcctgacggagcgacgccgcgtgagggaggaaggccttcgggtcgtaaacctctgttgtcagggacgaacccgtgcggttcgaagagggccgtgcgctgacggtacctgacgaggaagccccggctaactacgtgccagcagccgcggtaaaacgtagggggcgagcgttgtccggaattactgggcgtaaagcgcgcgtaggcggcctcttaagtccggtgtgaaagcccgcggctcaaccgcgggaggccactggaaactgggaggcttgagggcaggagaggggagtggaattcccggtgtagcggtgaaatgcgtagagatcgggaggaacaccagtggcgaaggcggctccctggcctgtacctgacgctgaggcgcgaaagcgtggggagcaaacaggattagataccctggtagtccacgccgtaaacgatgggtgctaggtgtgaggggcgtttggcccttcgtgccgaagctaacgcgataagcaccccgcctggggagtacggccgcaaggctgaaactcaaaggaattgacgggggcccgcacaagcggtggagcatgtggtttaattcgaagcaacgcgaagaaccttaccagggcttgacatcccgctgaccgccccagagatggggtttccctcctttcggaggcagcggtgacaggtggtgcatggttgtcgtcagctcgtgtcgtgagatgttgggttaagtcccgcaacgagcgcaacccctgcccctagttgccagcgggtgaggccgggcactctagggggactgccggcgacaagccggaggaaggtggggatgacgtcaaatcatcatgccccttatgccctgggctacacacgtgctacaatggccggtacaaagggttgcgaacccgcgagggggagccaatcccaaaaagccggtctcagttcggattgcaggctgcaactcgcctgcatgaaggcggaatcgctagtaatcgcggatcagcatgccgcggtgaatacgttcccgggccttgtacacaccgcccgtcacaccacgagagtctgcaacacccgaagtcggtgcgccaacccttacggggaggcagccgccgaaggtggggcagatgattggggtgaagtcgtaacaaggtatccgtaccggaaggtgcggatggatcacctcctttcta

SEQ ID NO: 2378 - DNA, 1554 bp, Calditerrivibrio nitroreducens
  ref <308>: DATABASE ACCESSION NUMBER: NCBI ACCESSION: NC_014758.1
  ref <309>: DATABASE ENTRY DATE: 2019-04-01
  ref <313>: RELEVANT RESIDUES IN SEQ ID NO: (1)..(1554)
atggagagtttgatcctggctcagaacgaacgctggcggcacgcttaacacatgcaagtcaaggggaaagggcttcggcctgagtacactggcgcacgggtgagtaacgcgtgaggaatctgcccataagactgggataacacaccgaaaggtgtgctaatactggatgtgttccataggcgcatgcttatggagtaaaggcggggtaacctgtcgcttatggatgacctcgcgtccgattagctagttggtggggtaatggcctaccaaggcgacgatcggtagccggcctgagagggtggccggccacactggaactgagacacggtccagactcctacgggaggcagcagtggggaatcttgcgcaatgggggcaaccctgacgcagcgatgccgcgtggacgaagaaggccttcgggtcgtaaagtcctttcgctggggaagaaagctattagtagtaactgactgatagttgacggtacccagataagcagccccggctaactccgtgccagcagccgcggtaatacggagggggcaagcgttgttcggaattactgggcgtaaagcgcacgtaggcggttttgtaagtctggggtcaaaggcgacagctcaactgtcgtaaggccttagatactatagaactggagtgccagagaggatggcggaattcccggtgtagcggtgaaatgcgtagatatcgggaggaacaccattggcgaaggcggctatctggctggtaactgacgctgaggtgcgagagcgtagggagcaaacaggattagataccctggtagtctacgctgtaaacgatggatgttagatgttggtggaaccgaccccatcagtgtcgaagctaacgcgttaaacatcccgcctggggagtatgctcgcaagagtgaaactcaaaggaattgacgggggcccgcacaagcggtggagcacgtggtttaattcgatgataaccgaagaaccttacctgggtttgacatcccaagaaccctgcagagatgtgggggtgccgggcttgctcggagcttggagacaggtgctgcatggctgtcgtcagctcgtgccgtgaggtgttgggttaagtcccgcaacgagcgcaacccctgttagtagttgccatcaggtaaagctgggcactctactgagactgccggcgataagccggaggaaggtggggatgacgtcaagtcatcatggcccttatgtccagggctacacacgtgctacaatggcgtatacagagggcagcgagacagtgatgttaagcgaatcccagaaagtacgccgtagttcggattgcagtctgcaactcgactgcatgaagtcggaatcgctagtaatcgcaggtcagcaaaactgcggtgaatacgttcccgggccttgtacacaccgcccgtcacaccatgggagttggtcgtgcctgaagccggtggcctaaccgcgagggaggagccgtctatggcatggtcgatgactggggtgaagtcgtaacaaggtagccgtaccggaaggtgtggctggatcacctcctttttaagga

SEQ ID NO: 2379 - DNA, 1540 bp, Caldithrix abyssi
  ref <308>: DATABASE ACCESSION NUMBER: NCBI ACCESSION: NZ_CP018099.1
  ref <309>: DATABASE ENTRY DATE: 2019-04-01
  ref <313>: RELEVANT RESIDUES IN SEQ ID NO: (1)..(1540)
tggagagtttgatcctggctcaggacgaacgctggcggcgtgcctaacacatgcaagtcaaggggaaaggcggacttcggtttgccgagtatactggcggacgggtgagtaacgcgtaggcaacctgcccttatgtctgggataacctcgagaaatcggggctaataccggataaggtcaattggccgcatggttaattgattaaaggtgccgcaaggtactgcataaggatgggcctgcgttccattagctagatggtagggtaacggcctaccatggcgacgatggatagctgatctgagaggatgatcagccacactgggattgagatacggcccagactcctacgggaggcagcagtgaggaatattgcgcaatgggggcaaccctgacgcagcaacgccgcgtgggggaagaagctctatggagtgtaaacccctgtaggtagggaagaaagtcatggcttcgcaaggggtcatgtttgacggtacctacaaagtaagctccggctaactccgtgccagcagccgcggtaatacggggggagcaagcgttgtccggaatcactgggcgtaaagggcgtgtaggcggtctggtaagtcagatgtgaaatcccacggcttaaccgtggaattgcatttgaaactgccggacttgagtgcgagagagggtagtggaattcccggtgtagcggtgaaatgcgtagatatcgggaagaacaccagtagcgaaggcggctacctggctcgtaactgacgctaaggcgcgaaagcgtggggagcaaacaggattagataccctggtagtccacgccgtaaacgatgggcactaggtgttggggccgacttgtcggcctcagtgccgcagccaacgcattaagtgccccgcctggggagtacgctcgcaagggtgaaactcaaaggaattgacgggggcccgcacaagcggtggagcatgtggtttaattcgatgcaacgcgaagaaccttaccggggtttgacatgccgatgacgtcacgggagaccgtgattcccttcggggcgtcggcacaggtgctgcatggctgtcgtcagctcgtgtcgtgagatgttgggttaagtcccgcaacgagcgcaacccctgcctctagttaccatcggttcaagccggggactctagagggactgccggcgataagctggaggaaggtggggatgacgtcaagtcctcatggcccttacaccccgggctacacacgtgctacaatggccggtacagcgagttgcgaaaccgcgaggtggagccaatctctaaaaaccggtctcagttcggattgcagtctgcaactcgactgcatgaagtcggaatcgctagtaatcgcggatcagcatgccgcggtgaatacgttcccgggccttgtacacaccgcccgtcacgccatggaagtcggcagtacccgaagcccccgcattagcggggtcgaaggtaaggccgatgactggggcgaagtcgtaacaaggtagccgtaccggaaggtgcggctggatcacctcctttctaa

SEQ ID NO: 2380 - DNA, 1530 bp, Calidifontibacter indicus
  ref <308>: DATABASE ACCESSION NUMBER: NCBI ACCESSION: NZ_QTUA01000001.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacgatgaagccgcagcttgctgtggtggattagtggcgaacgggtgagtaacacgtgagtaacctgcccttcactctgggataagccttggaaacgaggtctaatactggatattcattcatgatcgcatggttgtgggtggaaagattttttggtgggggatggactcgcggcctatcagcttgttggtgaggtagtggcttaccaaggctttgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcaccagggacgaagcggaagtgacggtacctggagaagaagcaccggctaactacgtgccagcagccgcggtaatacgtagggtgcgagcgttgtccggaattattgggcgtaaagagcttgtaggcggtttgtcgcgtctgctgtgaaagaccggggcttaactccggttctgcagtgggtacgggcaggctagagtatggtaggggagactggaattcctggtgtagcggtgaaatgcgcagatatcaggaggaacaccgatggcgaaggcaggtctctgggccattactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaatgtgccagagatggtgcagccttttggctggtgtacaggtggtgcatggttgtcgtcagctcgtgtcgtgagatgttgggttaagtcccgcaacgagcgcaaccctcgttccatgttgccagcacgtgatggtggggactcatgggagactgccggggtcaactcggaggaaggtggggatgacgtcaaatcatcatgccccttatgtcttgggcttcacgcatgctacaatggccggtacagagggcagcgatactgtgaggtggagcgaatcccttaaaaccggtctcagttcggattggggtctgcaactcgaccccatgaagttggagtcgctagtaatcgcagatcagcagtgctgcggtgaatacgttcccgggccttgtacacaccgcccgtcaagtcacgaaagttggtaacacccgaagccggtggcctaacccttgtggggggagccgtcgaaggtgggattggcgattgggactaagtcgtaacaaggtagccgtaccggaaggtgcggctggatcacctcctttctaagga

SEQ ID NO: 2381 - DNA, 1532 bp, Caloramator australicus
  ref <308>: DATABASE ACCESSION NUMBER: NCBI ACCESSION: NZ_CAKP01000003.1
  ref <309>: DATABASE ENTRY DATE: 2019-04-01
  ref <313>: RELEVANT RESIDUES IN SEQ ID NO: (1)..(1532)
tttaaacataagagtttgatcctggctcaggacgaacgctggcggcgtgcctaacacatgcaagtcgagcggagatgccaaggagcaatccaaggtgtcttagcggcggacgggtgagtaacacgtgggtaacctaccccaaggagggggataacaggtcgaaagacctgctaataccgcataaagcttgtgtgtcgcatgatacataagccaaaggaggaatccgccttgggatgggcccgcggcccattagctagttggtgaggtaacggctcaccaaggcgacgatgggtagccggcctgagagggtggtcggccacactgggactgagacacggcccagactcctacgggaggcagcagtggggaatattgcgcaatgggggaaaccctgacgcagcgacgccgcgtgagcgaagaaggccttcgggttgtaaagctctgtcttccctgacgaagaaagtgacggtaagggaggaggaagccacggctaactacgtgccagcagccgcggtaatacgtaggtggcgagcgttgtccggaattactgggcgtaaagggtgcgtaggcggctccttaagtgaggtgtgaaatccctgggctcaacccaggaactgcacttcaaactggggagctagagtgcaggagaggaaagcggaattcccggtgtagcggtgaaatgcgtagagatcgggaggaacaccagtggcgaaggcggctttctggactgtaactgacgctgaggcacgaaagcgtggggagcaaacaggattagataccctggtagtccacgctgtaaacgatgagtgctaggtgtgggaggcgtagccttccgtgccgcagttaacacattaagcactccgcctggggagtacggtcgcaagattaaaactcaaaggaattgacgggggcccgcacaagcagcggagcatgtggtttaattcgaagcaacgcgaagaaccttaccagggcttgacatccaccgaaccctgtggagacatgggggtgccctctttgagggagcggtgagacaggtggtgcatggttgtcgtcagctcgtgtcgtgagatgttgggttaagtcccgcaacgagcgcaacccctatcgttagttgccagcacttcgggtgggcactctaacgagactgccagggtaacctggaggaaggtggggatgacgtcaaatcatcatgccccttatgtcctgggctacacacgtgctacaatggccactacagagagaagcgaagcagcgatgcggagcaaatctttaaaagtggtcccagttcggattgcaggctgcaactcgcctgcatgaagccggagttgctagtaatcgcggatcagcatgccgcggtgaatacgttcccgggccttgtacacaccgcccgtcacaccatgagagccggcaacacccgaagccagtgggctaaccgattaggaggcagctgtcgaaggtggggctggtgattggggtgaagtcgtaacaaggtagccgtaggagaacctgcggctggatcacctcctttctaa

SEQ ID NO: 2382 - DNA, 1322 bp, Caloramator mitchellensis
  ref <308>: DATABASE ACCESSION NUMBER: NCBI ACCESSION: NZ_LKHP01000039.1
  ref <309>: DATABASE ENTRY DATE: 2019-04-01
  ref <313>: RELEVANT RESIDUES IN SEQ ID NO: (1)..(1322)
atagccaaaggagaaatccgccttaggatgggcccgcggcccattagctagttggtgaggtaacggctcaccaaggcgacgatgggtagccggcctgagagggtggccggccacactgggactgagacacggcccagactcctacgggaggcagcagtggggaatattgcgcaatgggggaaaccctgacgcagcgacgccgcgtgagcgaagaaggccttcgggttgtaaagctctgtcttccctgacgaagagatgacggtaagggaggaggaagccacggctaactacgtgccagcagccgcggtaatacgtaggtggcgagcgttgtccggaattattgggcgtaaagggtgcgtaggcggctctttaagtgaggtgtgaaaaccctgggctcaaccgagggatggcacttcaaactggggagctagagtgcaggagaggaaagtggaattcccagtgtagcggtgaaatgcgtagagattgggaggaacaccagtggcgaaggcgactttctggactgtaactgacgctgaggcacgaaagcgtggggagcaaacaggattagataccctggtagtccacgctgtaaacgatgagtgctaggtgtgggaggcgtagccttccgtgccgcagttaacacattaagcactccgcctggggagtacggtcgcaagattaaaactcaaaggaattgacgggggcccgcacaagcagcggagcatgtggtttaattcgaagcaacgcgaagaaccttaccagggcttgacatccatcgaatcctgtggaaacatgggagtgcctttcggggaacgatgagacaggtggtgcatggttgtcgtcagctcgtgtcgtgagatgttgggttaagtcccgcaacgagcgcaacccctatcgttagttgccagcattaaggtgggcactctaacgagactgccagggtaacctggaggaaggtggggatgacgtcaaatcatcatgccccttatgctctgggctacacacgtgctacaatggccactacagagagaagcgaggcagcgatgcggagcaaatcttttaaaagtggtcccagttcggattgcaggctgcaactcgcctgcatgaagctggagttgctagtaatcgcgaatcagaatgtcgcggtgaatacgttcccgggccttgtacacaccgcccgtcacaccatgagagccggcaacacccgaagccagtgggctaacccgaaagggaggcagctgtcgaaggtggggctggtgattggggtgaagtcgtaacaaggtagccgtaggagaacctgcggctggatcacctcctttcta

SEQ ID NO: 2383 - DNA, 1000 bp, Caloramator proteoclasticus
  ref <308>: DATABASE ACCESSION NUMBER: NCBI ACCESSION: NZ_FQVG01000122.1
  ref <309>: DATABASE ENTRY DATE: 2019-04-01
  ref <313>: RELEVANT RESIDUES IN SEQ ID NO: (1)..(1000)
agcgttgtccggaattactgggcgtaaagggtgcgtaggcggctctttaagtgggatgtgaaatccctgggctcaacccaggaactgcattccaaactggagagctagagtgcaggagaggaaagcggaattcccagtgtagcggtgaaatgcgtagagattgggaggaacaccagtggcgaaggcggctttctggactgtaactgacgctgaggcacgaaagcgtggggagcaaacaggattagataccctggtagtccacgctgtaaacgatgggtactaggtgtagggggcgaagccctctgtgccgcagctaacgcattaagtaccccgcctggggagtacggtcgcaagattaaaactcaaaggaattgacgggggcccgcacaagcagcggagcatgtggtttaattcgaagcaacgcgaagaaccttaccagggcttgacatccaccgaaccctgtggaaacacgggggtgcccttcggggaacggtgagacaggtggtgcatggttgtcgtcagctcgtgtcgtgagatgttgggttaagtcccgcaacgagcgcaacccttgcctttagttgccagcaattcggttgggcactctagagggactgcctgggttaaccaggaggaaggtggggatgacgtcaaatcatcatgccccttatgctctgggctacacacgtgctacaatggccggtacaatgagttgcaaacccgcgagggggagctaatctcaaaaaccggtcccagttcggattgtaggctgcaactcgcctacatgaagctggagttgctagtaatcgcggatcagcatgccgcggtgaatacgttcccgggccttgtacacaccgcccgtcacaccatgagagccggcaacacccgaagccagtgggctaacccgcaagggaggcagctgtcgaaggtggggctggtgattggggtgaagtcgtaacaaggtagccgtaggagaacctgcggctggatcacctcctttcta

SEQ ID NO: 2384 - DNA, 298 bp, Caloramator sp. ALD01
  ref <308>: DATABASE ACCESSION NUMBER: NCBI ACCESSION: NZ_AXAA01000052.1
  ref <309>: DATABASE ENTRY DATE: 2019-04-01
  ref <313>: RELEVANT RESIDUES IN SEQ ID NO: (1)..(298)
taacataagagtttgatcctggctcaggacgaacgctggcggcgtgcctaacacatgcaagtcgagcgatatggaggttggatgttagaggttagaggtttgaatagaagaaattcctacggaatttcaacaagtatccaacttctaatttccaacatctaacctctatatagcggcggacgggtgagtaacacgtgggtaacctgcccttgagagggggataacaggtcgaaaggcctgctaataccgcataatgctaagaagctgcatggcgtcttagccaaaggttaattccgct

SEQ ID NO: 2385 - DNA, 1037 bp, Caloranaerobacter azorensis
  ref <308>: DATABASE ACCESSION NUMBER: NCBI ACCESSION: NZ_FQXO01000003.1
  ref <309>: DATABASE ENTRY DATE: 2019-04-01
  ref <313>: RELEVANT RESIDUES IN SEQ ID NO: (1)..(1037)
gtgccagcagccgcggtaatacgtagggggcgagcgttgtccggaatcactgggcgtaaagggtgcgtaggcggccctgcaagtcaggtgtgaaaggcatcggctcaaccgatgtgagcacttgaaactgtagggcttgagtgcaggagaggagagcggaattcctagtgtagcggtgaaatgcgtagatattaggaggaacaccagtggcgaaggcggctctctggactgtaactgacgctgaggcacgaaagcgtgggtagcgaacaggattagataccctggtagtccacgccgtaaacgatgagtgctaggtgttggggggttagaccttcagtgccgcagttaacacattaagcactccgcctggggagtacggtcgcaagactgaaactcaaaggaattgacggggacccgcacaagcagcggagcatgtggtttaattcgaagcaacgcgaagaaccttaccaagacttgacatcctccggacggctctggagacagggctttcccttcggggactggagagacaggtggtgcatggttgtcgtcagctcgtgtcgtgagatgttgggttaagtcccgcaacgagcgcaacccttgcctttagttgccatcaggtaaagctgggcactctagagggactgccggctaaaagtcggaggaaggtggggatgacgtcaaatcatcatgccccttatgtcttgggctacacacgtgctacaatggccggtacagagggcagcgaacccgtaagggggagcgaatcccaaaaagccggtcccagttcggattgtgggctgcaactcgcccacatgaagctggagttgctagtaatcgcgaatcagaatgtcgcggtgaatgcgttcccgggtcttgtacacaccgcccgtcacaccatgagagtcggcaacacccgaagccagtgggctaaccgaaaggaggcagctgtcgaaggtggggccgatgattggggtgaagtcgtaacaaggtagccgtatcggaaggtgcggctggatcacctcctttctaaggag

SEQ ID NO: 2386 - DNA, 1514 bp, Caloranaerobacter ferrireducens
  ref <308>: DATABASE ACCESSION NUMBER: NCBI ACCESSION: NZ_MDJR01000022.1
  ref <309>: DATABASE ENTRY DATE: 2019-04-01
  ref <313>: RELEVANT RESIDUES IN SEQ ID NO: (1)..(1514)
cttgagagtttgatcctggctcaggacgaacgctggcggcgtgcctaacacatgcaagtcgagcgggtaggtgctttaatgaaccttcgggggatttaaagtaccgaaagcggcggacgggtgagtaacgcgtgggaaacctgccctatgcagggggatagcctcgggaaaccgggattaataccccataaaactctaacaccgcatggtgtgtgagtcaaagctttagcggcataggatggtcccgcgtcccattagctagttggtgaggtaacggctcaccaaggcgacgatgggtagccggcctgagagggtggacggccacactgggactgagacacggcccagactcctacgggaggcagcagtggggaatattgcacaatgggcgaaagcctgatgcagcgacgccgcgtgagcgaagaaggccttcgggtcgtaaagctctgtcctaagggaagaattttgacggtaccttaggaggaagccccggctaactacgtgccagcagccgcggtaatacgtagggggcgagcgttgtccggaatcactgggcgtaaagggtgcgtaggcggccctgcaagtcaggtgtgaaaggcctcggctcaaccgaggtgagcacttgaaactgtagggcttgagtgcaggagaggagagcggaattcctagtgtagcggtgaaatgcgtagatattaggaggaacaccagtggcgaaggcggctctctggactgtaactgacgctgaggcacgaaagcgtggggagcgaacaggattagataccctggtagtccacgccgtaaacgatgagtgctaggtgttggggggtcataccttcagtgccgcagttaacacattaagcactccgcctggggagtacggtcgcaagactgaaactcaaaggaattgacggggacccgcacaagcagcggagcatgtggtttaattcgaagcaacgcgaagaaccttaccaagacttgacatcccccggaccgctctggagacagggctttcccttcggggactggggtgacaggtggtgcatggttgtcgtcagctcgtgtcgtgagatgttgggttaagtcccgcaacgagcgcaacccttgcctttagttgccatcaggtaaagctgggcactctagagggactgccggtgacaaaccggaggaaggtggggatgacgtcaaatcatcatgccccttatgtcttgggctacacacgtgctacaatggccggtacaacgggcagcgaacccgcgagggggagcgaatccctaaaagccggtcccagttcggattgtgggctgcaactcgcccacatgaagctggagttgctagtaatcgcgaatcagaacgtcgcggtgaatgcgttcccgggtcttgtacacaccgcccgtcacaccatgagagtcggcaacacccgaagccagtgggctaaccgtaaggaggcagctgtcgaaggtggggccgatgattggggtgaagtcgtaacaaggtagccgtatcggaaggggcgg

SEQ ID NO: 2387 - DNA, 1539 bp, Caloranaerobacter sp. TR13
  ref <308>: DATABASE ACCESSION NUMBER: NCBI ACCESSION: NZ_JXLL01000045.1
  ref <309>: DATABASE ENTRY DATE: 2019-04-01
  ref <313>: RELEVANT RESIDUES IN SEQ ID NO: (1)..(1539)
ttttgatcttgagagtttgatcctggctcaggacgaacgctggcggcgtgcctaacacatgcaagtcgagcgggtaggtgctttaatgaaccttcgggtgatttaaagtaccgaaagcggcggacgggtgagtaacgcgtgggaaacctgccctatgcagggggatagcctcgggaaaccgggattaataccccataaaactctaacaccgcatggtgtgtgagtcaaagctttagcggcataggatggtcccgcgtcccattagctagttggtgaggtaacggctcaccaaggcgacgatgggtagccggcctgagagggtggacggccacactgggactgagacacggcccagactcctacgggaggcagcagtggggaatattgcacaatgggcgaaagcctgatgcagcgacgccgcgtgagcgatgaaggccttcgggtcgtaaagctctgtcctaagggaagaattttgacggtaccttaggaggaagccccggctaactacgtgccagcagccgcggtaatacgtagggggcgagcgttgtccggaatcactgggcgtaaagggtgcgtaggcggccctgcaagtcaggtgtgaaaggcctcggctcaaccgaggtgagcacttgaaactgtagggcttgagtgcaggagaggagagcggaattcctagtgtagcggtgaaatgcgtagatattaggaggaacaccagtggcgaaggcggctctctggactgtaactgacgctgaggcacgaaagcgtggggagcgaacaggattagataccctggtagtccacgccgtaaacgatgagtgctaggtgttggggggtcataccttcagtgccgcagttaacacattaagcactccgcctggggagtacggtcgcaagactgaaactcaaaggaattgacggggacccgcacaagcagcggagcatgtggtttaattcgaagcaacgcgaagaaccttaccaagacttgacatcccccggaccgttctggagacagagctttcccttcggggactggggtgacaggtggtgcatggttgtcgtcagctcgtgtcgtgagatgttgggttaagtcccgcaacgagcgcaacccttgcctttagttgccatcaggtaaagctgggcactctagagggactgccggtgacaaaccggaggaaggtggggatgacgtcaaatcatcatgccccttatgtcttgggctacacacgtgctacaatggccggtacaacgggcagcgaacccgcgagggggagcgaatccctaaaagccggtcccagttcggattgtgggctgcaactcgcccacatgaagctggagttgctagtaatcgcgaatcagaacgtcgcggtgaatgcgttcccgggtcttgtacacaccgcccgtcacaccatgagagtcggcaacacccgaagccagtgggctaaccttttggaggcagctgtcgaaggtggggccgatgattggggtgaagtcgtaacaaggtagccgtatcggaaggtgcggctggatcacctcctttct

SEQ ID NO: 2388 - DNA, 1402 bp, Calothrix desertica
  ref <308>: DATABASE ACCESSION NUMBER: NCBI ACCESSION: NZ_RSCL01000097.1
  ref <309>: DATABASE ENTRY DATE: 2019-04-01
  ref <313>: RELEVANT RESIDUES IN SEQ ID NO: (1)..(1402)
gcggacgggtgagtaacgcgtgagaatctgtcttcaggtcggggacaacagttagaaatgactgctaataccggatatgccgaaaggtgaaagatttattgcctgaaaaagagctcgcgtcagattagctagtaggtggtgtaagagactacctaggcttcgatctgtagctggtctgagaggacgatcagccacactggaactgagacacggtccagactcctacgggaggcagcagtggggaattttccgcaatgggcgaaagcctgacggagcaataccgcgtgagggacgaaggcttttgggtcgtaaacctcttttctcaaggaagattaagacggtacttgaggaataagcatcggctaactctgtgccagcagccgcggtaatacagaggatgcaagcgttatccggaatgattgggcgtaaagcgtccgcaggtggttttataagtctgctgttaaagcgttaggctcaacctaataagggcagtggaaactataagactagagtatgttaggggtagagggaattcccagtgtagcggtgaaatgcgtagagattgggaagaacaccggtggcgaaagcgctctgctaggacaatactgacactgagggacgaaagctaggggagcgaatgggattagataccccagtagtcctagccgtaaacgatggatactaggcgttgcccgtatcgacccgggcattgtcgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatgtcgcgaaccctgctgaaaggtgggggtgccttcgggagcgcgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcagcatgccccttacgtcctgggctacacacgtactacaatgctacgaacaaagggcagctagttagcaataacatgcaaatctcagaaatcgtagctcagttcagattgaaggctgcaactcgccttcatgaagtcggaatcgctagtaattgcaggtcagcatactgcagtgaattcgttcccgggccttgtacacaccgcccgtcacaccatggaagctggtcacgcccgaagtagttatcctaacagttcgctgggggagactccgaaggtagggctggtgactggggtgaagtcgtaacaaggtagccgtaccggaaggtgtggctggatcacctccttttt

SEQ ID NO: 2389 - DNA, 1490 bp, Calothrix parietina
  ref <308>: DATABASE ACCESSION NUMBER: NCBI ACCESSION: NC_019751.1
  ref <309>: DATABASE ENTRY DATE: 2019-04-01
  ref <313>: RELEVANT RESIDUES IN SEQ ID NO: (1)..(1490)
aaaacggagagtttgatcctggctcaggatgaacgctggcggtatgcttaacacatgcaagtcgaacgggcactttagggtgttagtggcggacgggtgagtaacgcgtgagaatctagctctaggtctaggacaaccattggaaacggtggctaatactggatgtgccgggaggtaaaaggcttgctgcctagagaagagcttgcgtcagattagctagtaggtgtggtaagagcgcacctaggcgacgatctgtagctggtctgagaggacgatcagccacactggaactgagacacggtccagactcctacgggaggcagcagtggggaattttccgcaatgggcgaaagcctgacggagcaataccgcgtgagggaggaaggctcttgggttgtaaacctcttttctctaggaagataatgacggtactagaggaataagcatcggctaactccgtgccagcagccgcggtaatacggaggatgcaagcgttatccggaatgattgggcgtaaagcgtccgcaggtggttttaaaagtctgttgttaaagcgtgaggcttaacctcataagggcaatggaaactataagactagagtacgttcggggcaaaggggaattcccagtgtagcggtgaaatgcgtagagattgggaagaacaccggtggcgaaagcgccttgctaggccgtaactgacactgagggacgaaagctaggggagcgaatgggattagataccccagtagtcctagccgtaaacgatggatactaggcgttgtctgtatcgacccggacagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccagaatcttgctgaaaggtgagagtgccttagggagctggaacacaggtggtgcatggctgtcgtcagctcgtgtcgtgagatgttgggttaagtcccgcaacgagcgcaaccctcgtccttagttgccatcattaagttgggaactctagggagactgccggtgacaaaccggaggaaggtggggatgacgtcaagtcagcgtgccccttacgtcctgggctacacacgtactacaatgctacagacaatgggaagctacacagcgatgtgatgcgaaactcagaaactgtggctcagttcagattgcaggctgcaactcgcctgcatgaaggaggaatcgctagtaattgcaggtcagcatactgcagtgaattcgttcccgggccttgtacacaccgcccgtcacaccatggaagctggtagtgcccgaagtcgttaccctaactgcttgcagagggggatgcctaaggcgagactggtgactggggtgaagtcgtaacaaggtagccgtaccggaaggtgtggctggatcacctcctttt

SEQ ID NO: 2390 - DNA, 1488 bp, Calothrix sp. 336 3
  ref <308>: DATABASE ACCESSION NUMBER: NCBI ACCESSION: NZ_CP011382.1
  ref <309>: DATABASE ENTRY DATE: 2019-04-01
  ref <313>: RELEVANT RESIDUES IN SEQ ID NO: (1)..(1488)
aaaatggagagtttgatcctggctcaggatgaacgctggcggtatgcttaacacatgcaagtcgaacggactcttcggagttagtggcggacgggtgagtaacgcgtgagaatctgccttttggttcgggacaacagttggaaacggctgctaataccggatgtgcctacgggtgaaagattaattgccaagagatgagctcgcgtctgattagctagttggtggtgtaatggactaccaaggctgcgatcagtagctggtctgagaggatgatcagccacactggaactgagacacggtccagactcctacgggaggcagcagtggggaattttccgcaatgggcgaaagcctgacggagcaataccgcgtgagggaggaaggctcttgggttgtaaacctcttttctcagggaagatgatgacggtacctgaggaataagcatcggctaactccgtgccagcagccgcggtaatacggaggatgcaagcgttatccggaatgattgggcgtaaagcgtccgcaggtggttttgtaagtctattgttaaagcgtgcggcttaaccgcataagggcagtggaaactacaagactagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgttgtctgtatcgacccggacagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaatcttggggaaactcaggagtgccttcgggagccggaacacaggtggtgcatggctgtcgtcagctcgtgtcgtgagatgttgggttaagtcccgcaacgagcgcaaccctcgttcttagttgccagcactttgggtgggcactctagggagactgccggtgacaaaccggaggaaggtggggatgacgtcaagtcagcatgccccttacgtcctgggctacacacgtactacaatgctatagacaaagggcagcaagctagcgatagcaagctaatctcataaactatggctcagttcagatcgcaggctgcaactcgcctgcgtgaaggaggaatcgctagtaattgcaggtcagcatactgcagtgaattcgttcccgggccttgtacacaccgcccgtcacaccatggaagctggtcacgcccgaagtcgttaccctaaccgttcgcggagggggacgccgaaggtaggactggtgactggggtgaagtcgtaacaaggtagccgtaccggaaggtgtggctggatcacctcctttt

SEQ ID NO: 2391 - DNA, 1493 bp, Calothrix sp. PCC 7103
  ref <308>: DATABASE ACCESSION NUMBER: NCBI ACCESSION: NZ_KB217478.1
  ref <309>: DATABASE ENTRY DATE: 2019-04-01
  ref <313>: RELEVANT RESIDUES IN SEQ ID NO: (1)..(1493)
aaaacggagagtttgatcctggctcaggatgaacgctggcggtatgcttaacacatgcaagtcgaacggtaccttcgggtatagtggcggacgggtgagtaacgcgtgagaatctgtcttcaggtcggggacaacagttagaaatgactgctaataccggatgtgccgaaaggtgaaagatttattgcctgaaattgagctcgcgtcagattagctagtaggtggtgtaagagactacctaggcatcgatctgtagctggtctgagaggacgatcagccacactggaactgagacacggtccagactcctacgggaggcagcagtggggaattttccgcaatgggcgaaagcctgacggagcaataccgcgtgagggacgaaggcttttgggtcgtaaacctcttttctcaaggaagataatgacggtacttgaggaataagcatcggctaactctgtgccagcagccgcggtaatacagaggatgcaagcgttatccggaatgattgggcgtaaagcgtccgcaggtggttttgtaagtctgctgttaaagcgtgtggctcaaccacatacaggcagtggaaactataagactagagtatgttaggggtagagggaattcccagtgtagcggtgaaatgcgtagagattgggaagaacaccggtggcgaaagcgctctgctaggacaatactgacactgagggacgaaagctaggggagcgaatgggattagataccccagtagtcctagccgtaaacgatggatactaggcgttgcccgtatcgacccgggcattgtcgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatgtcgcgaaccctgctgaaaggtgggggtgccttcgggagcgcgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcagcatgccccttacgtcctgggctacacacgtactacaatgctacgaacaaagggcagctagttagcaataacatgcaaatctcagaaatcgtagctcagttcagattgaaggctgcaactcgccttcatgaagtcggaatcgctagtaattgcaggtcagcatactgcagtgaattcgttcccgggccttgtacacaccgcccgtcacaccatggaagctggtcacgcccgaagtagttatcctaacagttcgctgggggagactccgaaggtagggctggtgactggggtgaagtcgtaacaaggtagccgtaccggaaggtgtggctggatcacctcctttttaggga

SEQ ID NO: 2392 - DNA, 1493 bp, Calothrix sp. PCC 7507
  ref <308>: DATABASE ACCESSION NUMBER: NCBI ACCESSION: NC_019682.1
  ref <309>: DATABASE ENTRY DATE: 2019-04-01
  ref <313>: RELEVANT RESIDUES IN SEQ ID NO: (1)..(1493)
aaaacggagagtttgatcctggctcaggatgaacgctggcggtatgcttaacacatgcaagtcgaacgaaatctttagggattgagtggcggacgggtgagtaacgcgtgagaatctgccttcaggttggggacaaccactggaaacggtggctaataccgaatgtgccgagaggtgaaaggcttgctgcctgaagaagagctcgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaaaaaaatgacggtacctgaggaataagcatcggctaactccgtgccagcagccgcggtaatacggaggatgcaagcgttatccggaatgattgggcgtaaagcgtccgcaggtggctatgtaagtctgctgttaaagagtgaggctcaacctcataaaagcagtggaaactacaaggctagagtacgttcggggcagagggaattcctggtgtagcggtgaaatgcgtagagatcaggaagaacaccggtggcgaaagcgctctgctaggccgtaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcctgctgaaaggtgggagtgccttcgggagcgcgaacacaggtggtgcatggctgtcgtcagctcgtgtcgtgagatgttgggttaagtcccgcaacgagcgcaaccctcgtttttagttgccagcacttagggtgggcactctagagagactgccggtgacaaaccggaggaaggtggggatgacgtcaagtcagcatgccccttacgtcttgggctacacacgtactacaatgctacggacagagggcagcaagctagcgatagcaagctaatcccggaaaccgtagctcagttcagatcgcaggctgcaactcgcctgcgtgaaggaggaatcgctagtaattgcaggtcagcatactgcagtgaattcgttcccgggccttgtacacaccgcccgtcacaccatggaagctggtcacgcccgaagtcgttaccccaacctttcgaggagggggatgcctaaggcaggactggtgactggggtgaagtcgtaacaaggtagccgtaccggaaggtgtggctggatcacctcctttt

SEQ ID NO: 2393 - DNA, 1518 bp, Campylobacter blaseri
  ref <308>: DATABASE ACCESSION NUMBER: NCBI ACCESSION: NZ_PDHI01000011.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcctaatacatgcaagtcgaacgatgaagcttctagcttgctagaagtggattagtggcgcacgggtgagtaatgtatagctaacctgcccctcagaagagaacaacagttagaaatgactgctaatactctatactccttcttaacataagttaagtcgggaaatgtcttttcgctgagggatggggctatattgtatcagtttgttggtggggtaatggcctaccaagactatgacgcataactggtctgagaggatgatcagtcacactggaactgagacacggtccagactcctacgggaggcagcagtaaggaatattgcgcaatgggcgaaagcctgacgcagcaacgccgcgtggaggatgacacttttcggagcgtaaactccttttgttagggaagaataatgacggtacctaacgaataagcaccggctaactccgtgccagcagccgcggtaatacggagggtgcaagcgttactcggaatcactgggcgtaaagggcgcgtaggcggattatcaagtctcttgtgaaatctggtggcttaaccatcaaactgcttgggaaactgatagtctagagtgagggagaggtagatggaattcttggtgtaggggtaaaatccgtagagatcaagaggaatacctattgcgaaagcgatctactagaactcaactgacgctgaggcgcgaaagcgtgggtagcaaacaggattagataccctggtagtccacgccctaaacgatgtatactagttgttgctgtgctagacacggcagtaatgcacctaacggattaagtataccgcctggggagtacggtcgcaagattaaaactcaaaggaatagacggggacccgcacaagcggtggagcatgtggtttaattcgaagatacgcgaagaaccttacctgggcttgacttccaacaaatcttttagagatagaagagtgcttgtttacaagaatgttgtgacaggtgctgcacggctgtcgtcagctcgtgtcgtgagatgttgggttaagtcccgcaacgagcgcaacccacgtgtttagttgctaacagttaggctgagcactctaaacagactgccttcgtaaggaggaggaaggtgtggacgacgtcaagtcatcatggcccttatgcccagggcgacacacgtgctacaatgacatatacaatgagaagcaatatcgcgaggtggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagccggaatgcaaaacttgctaccgtccacagtggaattagcgactggggtgaagtcgtaacaaggtaaccgtaggtgaacctgcggttggatcacctcctttcta

SEQ ID NO: 2394 - DNA, 1514 bp, Campylobacter concisus
  ref <308>: DATABASE ACCESSION NUMBER: NCBI ACCESSION: NZ_PIRT01000021.1
  ref <309>: DATABASE ENTRY DATE: 2019-04-01
  ref <313>: RELEVANT RESIDUES IN SEQ ID NO: (1)..(1514)
aatatggagagtttgatcctggctcagagtgaacgctggcggcgtgcctaatacatgcaagtcgaacggacaagtaagagcttgctcttatgagttagtggcgcacgggtgagtaatgtatagctaatctgccctacactagaggacaacagttggaaacgactgctaatactctatactcctgtctgacataagttagatagggaaagtttttcggtgtaggatgaggctatattgtatcagctagttggtgaggtaatggctcaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttagggaagaacaatgacggtacctaacgaataagcaccggctaactccgtgccagcagccgcggtaatacggagggtgcaagcgttactcggaatcactgggcgtaaaggacgcgtaggcggattatcaagtctcttgtgaaatcctatggcttaaccatagaactgcttgggaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctaagctagtcttggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtcattagttgctaacagttcggctgagcactctaatgagactgccttcgtaaggaggaggaaggtgtggacgacgtcaagtcatcatggcccttatgtccggggcgacacacgtgctacaatggcatatacaatgagaagcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagccggaatactaaattagttaccgtccacagtggaatcagcgactggggtgaagtcgtaacaaggtaaccgtaggagaacctgcggttggatcacctcctttcta

SEQ ID NO: 2395 - DNA, 1516 bp, Campylobacter cuniculorum
  ref <308>: DATABASE ACCESSION NUMBER: NCBI ACCESSION: NZ_CP020867.1
  ref <309>: DATABASE ENTRY DATE: 2019-04-01
  ref <313>: RELEVANT RESIDUES IN SEQ ID NO: (1)..(1516)
tttatggagagtttgatcctggctcagagtgaacgctggcggcgtgcctaatacatgcaagtcgaacgatgaagcttctagcttgctagaagtggattagtggcgcacgggtgagtaaggtatagttaatctgccctacactagggaataacacttagaaatgagtgctaataccctatactcctattgaacctaagtttaatagggaaagtttttcggtgtaggatgaggctatatagtatcagctagttggtggggtaaaggcttaccaaggctatgacgcttaactggtctgagaggatgatcagtcacactggaactgagacacggtccagactcctacgggaggcagcagtagggaatattgcgcaatgggcgaaagcctgacgcagcaacgccgcgtggaggatgacacttttcggagcgtaaactccttttcttagggaagaactttgacggtacctaaggaataagcaccggctaactccgtgccagcagccgcggtaatacggagggtgcaagcgttactcggaatcactgggcgtaaagggcgcgtaggcggattatcaagtcttttgtgaaatctaatggcttaaccattaaactgcttgagaaactgatagtctagagtgggggagaggcagatggaattggtggtgtaggggtaaaatccgtagatatcaccaagaatacccattgcgaaggcgatctgctggaacttaactgacgctaaggcgcgaaagcgtggggagcaaacaggattagataccctggtagtccacgccctaaacgatgtatgctagttgttggagtgctagtcatttcagtaatgcagctaacgcattaagcataccgcctggggagtacggtcgcaagattaaaactcaaaggaatagacggggacccgcacaagcggtggagcatgtggtttaattcgaggatacgcgaagaaccttacctgggcttgatatcctaagaaccctatagagatatgggggtgctagcttgctagaacttagagacaggtgctgcacggctgtcgtcagctcgtgtcgtgagatgttgggttaagtcccgcaacgagcgcaacccacgtatttagttgctaacagctcggctgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcataaagccggaatcgctagtaatcgcaaatcagccatgttgcggtgaatacgttcccgggtcttgtactcaccgcccgtcacaccatgggagttgatttcactcgaagaggggatgctaaatcggctactctccacagtggaatcagcgactggggtgaagtcgtaacaaggtaaccgtaggagaacctgcggttggatcacctcctttcta

SEQ ID NO: 2396 - DNA, 1518 bp, Campylobacter fetus
  ref <308>: DATABASE ACCESSION NUMBER: NCBI ACCESSION: NZ_LS483431.1
  ref <309>: DATABASE ENTRY DATE: 2019-04-01
  ref <313>: RELEVANT RESIDUES IN SEQ ID NO: (1)..(1518)
tttatggagagtttgatcctggctcagagtgaacgctggcggcgtgcctaatacatgcaagtcgaacggagtattaagagagcttgctcttttaatacttagtggcgcacgggtgagtaatgtatagttaatctgccctacactggaggacaacagttagaaatgactgctaatactccatactccttcttaacataagttaagtcgggaaagtttttcggtgtaggatgagactatattgtatcagctagttggtaaggtaatggcttaccaaggctttgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttagggaagaaccatgacggtacctaacgaataagcaccggctaactccgtgccagcagccgcggtaatacggagggtgcaagcgttactcggaatcactgggcgtaaaggacgcgtaggcggattatcaagtcttttgtgaaatctaacagcttaactgttaaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgctctaaacgatgtatactagttgttgctgtgctagtcacggcagtaatgcacctaacggattaagtataccgcctggggagtacggtcgcaagattaaaactcaaaggaatagacggggacccgcacaagcggtggagcatgtggtttaattcgaagatacgcgaagaaccttacctgggcttgatatccaactaatctcttagagataagagagtgctagcttgctagaaagttgagacaggtgctgcacggctgtcgtcagctcgtgtcgtgagatgttgggttaagtcccgcaacgagcgcaacccacgtatttagttgctaacagttcggctgagcactctaaatagactgccttcgcaaggaggaggaaggtgtggacgacgtcaagtcatcatggcccttatgcccagggcgacacacgtgctacaatggcatatacaatgagatgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagtcggaatgctaaactagctaccgcccacagtggaatcagcgactggggtgaagtcgtaacaaggtaaccgtaggagaacctgcggttggatcacctcctttcta

SEQ ID NO: 2397 - DNA, 1519 bp, Campylobacter geochelonis
  ref <308>: DATABASE ACCESSION NUMBER: NCBI ACCESSION: NZ_FIZO01000005.1
  ref <309>: DATABASE ENTRY DATE: 2019-04-01
  ref <313>: RELEVANT RESIDUES IN SEQ ID NO: (1)..(1519)
aatatggagagtttgatcctggctcagagtgaacgctggcggcgtgcctaatacatgcaagtcgaacggagaattaagagagcttgctcttttaattcttagtggcgcacgggtgagtaatatatagctaacctgccccttagaagagaacaacagttagaaatgactgctaatactctatactccaactaaacatatgtttggttgggaaagtcttttcgctaagggatggggctatattgtatcagtttgttggtgaggtaatggctcaccaagactatgacgcataactggtctgagaggatgatcagtcacactggaactgagacacggtccagactcctacgggaggcagcagtaaggaatattgcgcaatgggcgaaagcctgacgcagcaacgccgcgtggaggatgacacttttcggagcgtaaactccttttgttggggaagaataatgacggtacccaacgaataagcaccggctaactccgtgccagcagccgcggtaatacggggggtgcaagcgttactcggaatcactgggcgtaaagggcgcgtaggcggatgaataagtcttttgtgaaatctaacagcttaactgttaaactgcttaggaaactatttatctagagtaagggagaggcagatggaactggtggtgtaggggtaaaatccgtagagatcaccaagaatacctattgcgaaagcgatctgctagaacttaactgacgctgaggcgcgaaagcgtggggagcaaacaggattagataccctggtagtccacgccctaaacgatgtatactagttgttgctttgctagtcaaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatccaacaaattctttagagatagagaagtgctagcttgctagaatgttgagacaggtgctgcacggctgtcgtcagctcgtgtcgtgagatgttgggttaagtcccgcaacgagcgcaacccacgtgtttagttgctaacagttcggctgagcactctaaacagactgcctacgcaagtaggaggaaggtgtggacgacgtcaagtcatcatggcccttatgtccggggcgacacacgtgctacaatggcatatacaatgagaagcaatatcgcgagatggagcaaatctataaaatatgtctcagttcggattggagtctgcaactcgactccatgaagccggaatcgctagtaatcgtagatcagccatgctacggtgaatacgttcccgggtcttgtactcaccgcccgtcacaccatgggagttgatttcactcgaagtcggaatgctaaactagctaccgcccacagtggaatcagcgactggggtgaagtcgtaacaaggtaaccgtaggagaacctgcggttggatcacctcctttcta

SEQ ID NO: 2398 - DNA, 1516 bp, Campylobacter gracilis
  ref <308>: DATABASE ACCESSION NUMBER: NCBI ACCESSION: NZ_UFUN01000001.1
  ref <309>: DATABASE ENTRY DATE: 2019-04-01
  ref <313>: RELEVANT RESIDUES IN SEQ ID NO: (1)..(1516)
aatatggagagtttgatcctggctcagagtgaacgctggcggcgtgcctaatacatgcaagtcgaacggaatttaagagagcttgctcttttaaatttagtggcgcacgggtgagtaatatatagctaatctgccccttgctggaggacaacagttagaaatgactgctaatactccatactcctttttaccataagataaatcgggaaagaatttcggcaagggatgagactatatcgtatcagctagtcggtggggtaacggcctaccgaggctatgacgcgtaactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttgttagggaagaataatgacggtacctaacgaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagatatcaagaagaatacctattgcgaaggcgatctgctggaacttaactgacgctaatgcgtgaaagcgtggggagcaaacaggattagataccctggtagtccacgccctaaacgatgtataccggttgttgctgtgctagtcacggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgtaaggaggaggaaggtgtggacgacgtcaagtcatcatggcccttatgtccggggcgacacacgtgctacaatggcatatacaataagacgcaatatcgtaagatggagcaaatctaaaaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcgggaatgcgaaattcgctaccctccacagtggaatcagcgactggggtgaagtcgtaacaaggtaaccgtaggagaacctgcggttggatcacctcctttcta

SEQ ID NO: 2399 - DNA, 1514 bp, Campylobacter helveticus
  ref <308>: DATABASE ACCESSION NUMBER: NCBI ACCESSION: NZ_UIGN01000002.1
  ref <309>: DATABASE ENTRY DATE: 2019-04-01
  ref <313>: RELEVANT RESIDUES IN SEQ ID NO: (1)..(1514)
tatggagagtttgatcctggctcagagtgaacgctggcggcgtgcctaatacatgcaagtcgaacgatgaagcttttagcttgctagaagtggattagtggcgcacgggtgagtaaggtatagttaatctgccctacactgggggacaacacttagaaatgagtgctaataccccatactcctatttagcataagttagatagggaaagtttttcggtgtaggatgagactatatagtatcagctagttggtaaggtaaaggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttctttgggaagaattttgacggtaccaaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaacttaactgacgctaaggcgcgaaagcgtggggagcaaacaggattagataccctggtagtccacgccctaaacgatgtatgctagttgttgggatgctagtcatctcagtaatgcagctaacgcattaagcataccgcctggggagtacggtcgcaagattaaaactcaaaggaatagacggggacccgcacaagcggtggagcatgtggtttaattcgaggatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaaccctcgtccttagttgctaacgattcggtcgagcactctaaggagactgccttcgtaaggaggaggaaggtggggacgacgtcaagtcatcatggcccttacgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtgaatcagccatgtcacggtgaatacgttcccgggtcttgtactcaccgcccgtcacaccatgggagttgatttcactcgaagtggaaatactaaactagttatcccccacagtggaatcagcgactggggtgaagtcgtaacaaggtaaccgtaggagaacctgcggttggatcacctcctttcta

SEQ ID NO: 2400 - DNA, 1517 bp, Campylobacter hepaticus
  ref <308>: DATABASE ACCESSION NUMBER: NCBI ACCESSION: NZ_QURZ01000025.1
  ref <309>: DATABASE ENTRY DATE: 2019-04-01
  ref <313>: RELEVANT RESIDUES IN SEQ ID NO: (1)..(1517)
attatggagagtttgatcctggctcagagtgaacgctggcggcgtgcctaatacatgcaagttgaacgatgaaacttctagcttgctagaagtggattagtggcgcacgggtgagtaaggtatagttaatctgccctacacaagaggacaacagttggaaacgactgctaatactctatactcctacttaacacaagttaagtagggaaagttttttcggtgtaggatgagactatatagtatcagttagttggtgaggtaatggctcaccaagactatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattttgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgataatctagagtaaggtagaggcagatggaattggtggtgtaggggtaaaatccgtagatatcaccaagaatacccattgcgaaggcgatctgctagaacttaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacagtttggctgagcactctaaatagactgccttcgtaaggaggaggaaggtgtggacgacgtcaagtcatcatggcccttatgcccagggcgacacacgtgctacaatggcatatacaataagacgcaataccgcaaggtggagcaaatctataaaatatgtcttagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaaatagttaccgtccacagtggaatcagcgactggggtgaagtcgtaacaaggtaaccgtaggagaacctgcggttggatcacctcctttcta

SEQ ID NO: 2401 - DNA, 1512 bp, Campylobacter hominis
  ref <308>: DATABASE ACCESSION NUMBER: NCBI ACCESSION: NZ_UFUL01000001.1
  ref <309>: DATABASE ENTRY DATE: 2019-04-01
  ref <313>: RELEVANT RESIDUES IN SEQ ID NO: (1)..(1512)
tatggagagtttgatcctggctcagagtgaacgctggcggcgtgcctaatacatgcaagtcgaacgaacgaataagagcttgctcttataagttagtggcgcacgggtgagtaatatatagctaatctgcctcttagtagaggataacagtcggaaacgattgctaatactctatacttctgctttacataagtaaagtagagaaagtttttcgctaagagatgaggctatactgtatcagctagttggtaaggtaacggcttaccaaggctatgacgcataactggtctgagaggatgatcagtcacattggaactgagacacggtccaaactcctacgggaggcagcagtagggaatattgcgcaatgggggaaaccctgacgcagcaacgccgcgtggaggatgacacttttcggagcgtaaactccttttatcgggaaagaataatgacggtacccgatgaataagcaccggctaactccgtgccagcagccgcggtaatacggagggtgcaagcgttactcggaatcactgggcgtaaagggtgcgtaggtggattatcaagtctcttgtgaaatctaatagcttaactattaaattgcttgggaaactgatagtctagagtaggggagaggcagatggaactcttggtgtaggagtaaaatccgtagatatcaagaagaatacctattgcgaaagcgatctgctagaacctaactgacactgatgcacgaaagcgtggggagcaaacaggattagataccctggtagtccacgccctaaacgatgtataccggttgttgctttgctagtcaaggcagtaatccagctaacgcattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtatttagttgctaacagttaggctgagttctctaaatagactgccttcgtaaggaggaggaaggtgtggacgacgtcaagtcatcatggcccttatgtccggggcgacacacgtgctacaatgacatatacaatgagatgcaatatcgcaagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcggggatgcaaaatttgctaccctccacagtggaatcagcgactggggtgaagtcgtaacaaggtaaccgtaggagaacctgcggttggatcacctcctttcta

SEQ ID NO: 2402 - DNA, 1519 bp, Campylobacter hyointestinalis
  ref <308>: DATABASE ACCESSION NUMBER: NCBI ACCESSION: NZ_UIGO01000001.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcctaatacatgcaagtcgaacggagtattaagagagcttgctcttttaatacttagtggcgcacgggtgagtaatgtatagttaatctgccctacactggaggacaacagttagaaatgactgctaatactccatactccttcttaacataagttaagttgggaaagttttttcggtgtaggatgagactatattgtatcagctagttggtaaggtaatggcttaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttgttggggaagaaccatgacggtacccaacgaataagcaccggctaactccgtgccagcagccgcggtaatacggagggtgcaagcgttactcggaatcactgggcgtaaaggacgcgtaggcggattatcaagtcttttgtgaaatctaacagctcaactgttaaactgcttgagaaactgataatctagagtgagggagaggcagatggaattggtggtgtaggggtaaaatccgtagagatcaccaggaatacccattgcgaaggcgatctgctggaactcaactgacgctaatgcgtgaaagcgtggggagcaaacaggattagataccctggtagtccacgccctaaacgatgtatactagttgttgctgtgctagtcacggcagtaatgcacctaacggattaagtataccgcctggggagtacggtcgcaagattaaaactcaaaggaatagacggggacccgcacaagcggtggagcatgtggtttaattcgaagatacgcgaagaaccttacctgggcttgatatcctaataacatcttagagataagatagtgcttgtttacaagaaattagtgacaggtgctgcacggctgtcgtcagctcgtgtcgtgagatgttgggttaagtcccgcaacgagcgcaacccacgtatttagttgctaacagttcggctgagcactctaaatagactgccttcgtaaggaggaggaaggtgtggacgacgtcaagtcatcatggcccttatgcccagggcgacacacgtgctacaatggcatatacaatgagacgcaatatcgcgagatggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagtcggaatgctaaattagctaccgcccacagtggaatcagcgactggggtgaagtcgtaacaaggtaaccgtaggagaacctgcggttggatcacctcctttcta

SEQ ID NO: 2403 - DNA, 1516 bp, Campylobacter insulaenigrae
  ref <308>: DATABASE ACCESSION NUMBER: NCBI ACCESSION: NZ_LR134534.1
  ref <309>: DATABASE ENTRY DATE: 2019-04-01
  ref <313>: RELEVANT RESIDUES IN SEQ ID NO: (1)..(1516)
tttatggagagtttgatcctggctcagagtgaacgctggcggcgtgcctaatacatgcaagtcgaacgatgaagcaactagcttgctagttgtggattagtggcgcacgggtgagtaaggtatagttaatctgccctacacaagaggacaacagttggaaacgactgctaatactctatactcctatttaacataagttgagtagggaaagtttttcggtgtaggatgagactatatagtatcagctagttggtgaggtaatggctcaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggctcaaccattaaactgcttgggaaactgataatctagagtgagggagaggcagatggaattggtggtgtaggggtaaaatccgtagatatcaccaagaatacccattgcgaaggcgatctgctggaacttaactgacgctaaggcgcgaaagcgtggggagcaaacaggattagataccctggtagtccacgccctaaacgatgtacactagttgttgggatgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacggttaggccgagcactctaaatagactgccttcgtaaggaggaggaaggtgtggacgacgtcaagtcatcatggcccttatgcccagggcgacacacgtgctacaatggcatatacaatgagacgcaatatcgcaaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2404 - DNA, 1516 bp, Campylobacter jejuni
  ref <308>: DATABASE ACCESSION NUMBER: NCBI ACCESSION: NZ_LR134511.1
  ref <309>: DATABASE ENTRY DATE: 2019-04-01
  ref <313>: RELEVANT RESIDUES IN SEQ ID NO: (1)..(1516)
tttatggagagtttgatcctggctcagagtgaacgctggcggcgtgcctaatacatgcaagtcgaacgatgaagcttttagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2405 - DNA, 1515 bp, Campylobacter lanienae
  ref <308>: DATABASE ACCESSION NUMBER: NCBI ACCESSION: NZ_UFVC01000001.1
  ref <309>: DATABASE ENTRY DATE: 2019-04-01
  ref <313>: RELEVANT RESIDUES IN SEQ ID NO: (1)..(1515)
tttatggagagtttgatcctggctcagagtgaacgctggcggcgtgcctaatacatgcaagtcgaacggacaagtaagagcttgctcttatgagttagtggcgcacgggtgagtaatgtatagttaatctgccctatgctggaggacaacagttagaaatgactgctaatactccatactccttcttaacataagttaagttgggaaagttttttcggcataggatgagactatattgtatcagctagttggtgaggtaatggctcaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttagggaagaaatttgacggtacctaaggaataagcaccggctaactccgtgccagcagccgcggtaatacggagggtgcaagcgttactcggaatcactgggcgtaaaggacgcgtaggcggattatcaagtcttttgtgaaatctaatggcttaaccattaaactgcttgagaaactgataatctagagtgagggagaggcagatggaattggtggtgtaggggtaaaatccgtagagatcaccaagaatacccattgcgaaggcgatctgctagaactcaactgacgctaatgcgtgaaagcgtggggagcaaacaggattagataccctggtagtccacgccctaaacgatgtatactagttgttgctctgctagtcagggcagtaatgcacctaacggattaagtataccgcctggggagtacggtcgcaagattaaaactcaaaggaatagacggggacccgcacaagcggtggagcatgtggtttaattcgatgatacgcgaagaaccttacctgggcttgatatcctaagaacctcttagagataagagggtgctagcttgctagaacttagagacaggtgctgcacggctgtcgtcagctcgtgtcgtgagatgttcggttaagtccggcaacgagcgcaacccacgtatttagttgctaacagtttggctgagcactctaaatatactgccttcgtaaggaggaggaaggtgtggacgacgtcaagtcatcatggcccttatgcccagggcgacacacgtgctacaatggcatatacaatgagacgcaatatcgtgagatggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagtcggaatgctaaactagctaccgcccacagtggaatcagcgactggggtgaagtcgtaacaaggtaaccgtaggagaacctgcggttggatcacctcctttcta

SEQ ID NO: 2406 - DNA, 1517 bp, Campylobacter lari
  ref <308>: DATABASE ACCESSION NUMBER: NCBI ACCESSION: NZ_LR134508.1
  ref <309>: DATABASE ENTRY DATE: 2019-04-01
  ref <313>: RELEVANT RESIDUES IN SEQ ID NO: (1)..(1517)
tttatggagagtttgatcctggctcagagtgaacgctggcggcgtgcctaatacatgcaagtcgaacgatgaagcttttagcttgctagaagtggattagtggcgcacgggtgagtaaggtatagttaatctgccctacacaagaggacaacagttggaaacgactgctaatactctatactcctgcttaacacaagttgagtagggaaagttttttcggtgtaggatgagactatatagtatcagctagttggtgaggtaatggctcaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatccaacggcttaaccgttgaactgcttgggaaactggtagtctagagtgagggagaggcagatggaattggtggtgtaggggtaaaatccgtagatatcaccaagaatacccattgcgaaggcgatctgctggaacttaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacagttaggctgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2407 - DNA, 1514 bp, Campylobacter rectus
  ref <308>: DATABASE ACCESSION NUMBER: NCBI ACCESSION: NZ_RQYP01000005.1
  ref <309>: DATABASE ENTRY DATE: 2019-04-01
  ref <313>: RELEVANT RESIDUES IN SEQ ID NO: (1)..(1514)
aatatggagagtttgatcctggctcagagtgaacgctggcggcgtgcctaatacatgcaagtcgaacggagattaagtagcttgctatttaatcttagtggcgcacgggtgagtaatatatagctaatctgccctacactagaggacaacagttggaaacgactgctaatactctatactccttctttacataagttaagtcgggaaagtttttcggtgtaggatgaggctatatcgtatcagctagttggtagggtaacggcctaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgataatctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgtaaggaggaggaaggtgtggacgacgtcaagtcatcatggcccttatgtccggggcgacacacgtgctacaatggcgtatacaataagacgcaatatcgcgagatggagcaaatctataaaatacgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttcta

SEQ ID NO: 2408 - DNA, 1514 bp, Campylobacter showae
  ref <308>: DATABASE ACCESSION NUMBER: NCBI ACCESSION: NZ_UWOO01000001.1
  ref <309>: DATABASE ENTRY DATE: 2019-04-01
  ref <313>: RELEVANT RESIDUES IN SEQ ID NO: (1)..(1514)
aatatggagagtttgatcctggctcagagtgaacgctggcggcgtgcctaatacatgcaagtcgaacggagattaagtagcttgctatttaatcttagtggcgcacgggtgagtaatatatagctaacttgcccattactaagggacaacagttggaaacgactgctaataccttatactccgtatctatataaatagatacgggaaagtttttcggtaatggatagggctatatcgtatcagctagttggtaaggtaacggcttaccaaggctatgacgcgtaactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttcttgggaaagaattatgacggtacccaaggaataagcaccggctaactccgtgccagcagccgcggtaatacggagggtgcaagcgttactcggaatcactgggcgtaaaggacgcgtaggcggattatcaagtctcttgtgaaatctaacggcttaaccgttaaactgcttgggaaactgatagtctagagtaagggagaggcagatggaattcttggtgtaggggtaaaatccgtagagatcaagaagaatacccattgcgaaagcgatctgctggaacttaactgacgctaatgcgtgaaagcgtggggagcaaacaggattagataccctggtagtccacgccctaaacgatgtatactagttgttgcttcgctagtcgaggcagtaatgcacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatccagagatggaagagtgtctgcttgcagaaatgttaagacaggtgctgcacggctgtcgtcagctcgtgtcgtgagatgttgggttaagtcccgcaacgagcgcaacccacgtcattagttgctaacggttcggccgagcactctaatgagactgccttcgcaaggaggaggaaggtgtggacgacgtcaagtcatcatggcccttatgtccggggcgacacacgtgctacaatggcatatacaatgagaagcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaaccggttatggtccacagtggaatcagcgactggggtgaagtcgtaacaaggtaaccgtaggagaacctgcggttggatcacctcctttcta

SEQ ID NO: 2409 - DNA, 1552 bp, Campylobacter sp. AAUH-44UCsig-a
  ref <308>: DATABASE ACCESSION NUMBER: NCBI ACCESSION: NZ_PPCJ01000065.1
  ref <309>: DATABASE ENTRY DATE: 2019-04-01
  ref <313>: RELEVANT RESIDUES IN SEQ ID NO: (1)..(1552)
tttgttcggagagtttgatcctggctcaggacgaacgctggcggcgtgcttaacacatgcaagtcgaacgatgatgctccagctttgttggggtggattagtggcgaacgggtgagtaacacgtgagtaacctgccctcttctttgggataacggtcggaaacggctgctaatactggatattcactcattggcgcatgttggtgggtggaaaggtttttctggtgggggatgggctcgcggcctatcagcttgttggtggggtgatggcctaccaaggctttgacgggtaaccggcctgagagggtgaccggtcacattgggactgagatacggcccagactcctacgggaggcagcagtagggaattttgcacaatgggcgcaagcctgatgcagcgacgccgcgtgagggatgaaggccttcgggttgtaaacctttttcgctcatggtcaagccgcagctttgggttgtggtgagggtagtgggtaaagaagcgccggctaactacgtgccagcagccgcggtaatacgtagggcgcgagcgttgtccggaattattgggcgtaaagggcttgtaggcggttggccgcgtctgccgtgaaatcctctggcttaactgggggcgtgcggtgggtacgggttgacttgagtgcggtaggggagactggaattcctggtgtagcggtggaatgcgcagatatcaggaggaacaccggtggcgaaggcgggtctctgggccgttactgacgctgaggagcgaaagcgtggggagcgaacaggattagataccctggtagtccacgctgtaaacgttgggcactaggtgtgggggccacccgtggtttctgcgccgtagctaacgctttaagtgccccgcctggggagtacggtcgcaaggctaaaactcaaaggaattgacgggggcccgcacaagcggcggagcatgcggattaattcgatgcaacgcgaagaaccttaccaaggcttgacatgcaccctgacgctgcagagatgtggtggcatttggttgggggtgtgcaggtggtgcatggttgtcgtcagctcgtgtcgtgagatgttgggttaagtcccgcaacgagcgcaacccttgccctatgttgccagcacgttatggtggggactcgtgggggactgccggggttaactcggaggaaggtggggatgacgtcaaatcatcatgccccttatgtcttgggcttcacgcatgctacaatggttggtacagagtgttgcgatatcgtaaggtggagcgaatcacttaaagccagtctcagttcggattggggtctgcaactcgaccccatgaaggtggagtcgctagtaatcgcagatcagcaacgctgcggtgaatacgttctcgggccttgtacacaccgcccgtcacgtcacgaaagttggtaacacccgaagctcatggcctaaccggttttccggggggagtggtcgaaggtgggattggcgattgggacgaagtcgtaacaaggtagccgtaccggaaggtgcggctggatcacctcctttctagggag

SEQ ID NO: 2410 - DNA, 1516 bp, Campylobacter sp. BCW 6876
  ref <308>: DATABASE ACCESSION NUMBER: NCBI ACCESSION: NZ_MJWV01000017.1
  ref <309>: DATABASE ENTRY DATE: 2019-04-01
  ref <313>: RELEVANT RESIDUES IN SEQ ID NO: (1)..(1516)
tttatggagagtttgatcctggctcagagtgaacgctggcggcgtgcctaatacatgcaagtcgaacgatgaagcttttagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatttgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccatgtatttagttgctaacggttaggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2411 - DNA, 1516 bp, Campylobacter sp. BCW 6879
  ref <308>: DATABASE ACCESSION NUMBER: NCBI ACCESSION: NZ_MJWY01000007.1
  ref <309>: DATABASE ENTRY DATE: 2019-04-01
  ref <313>: RELEVANT RESIDUES IN SEQ ID NO: (1)..(1516)
tttatggagagtttgatcctggctcagagtgaacgctggcggcgtgcctaatacatgcaagtcgaacgatgaagcttttagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatttgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccatgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2412 - DNA, 1516 bp, Campylobacter sp. BCW 8709
  ref <308>: DATABASE ACCESSION NUMBER: NCBI ACCESSION: NZ_NXHX01000015.1
  ref <309>: DATABASE ENTRY DATE: 2019-04-01
  ref <313>: RELEVANT RESIDUES IN SEQ ID NO: (1)..(1516)
tttatggagagtttgatcctggctcagagtgaacgctggcggcgtgcctaatacatgcaagtcgaacgatgaagcttctagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttttagagataagagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2413 - DNA, 1516 bp, Campylobacter sp. BCW 8713
  ref <308>: DATABASE ACCESSION NUMBER: NCBI ACCESSION: NZ_NXHV01000029.1
  ref <309>: DATABASE ENTRY DATE: 2019-04-01
  ref <313>: RELEVANT RESIDUES IN SEQ ID NO: (1)..(1516)
tttatggagagtttgatcctggctcagagtgaacgctggcggcgtgcctaatacatgcaagtcgaacgatgaagcttctagcttgctagaagtggattagtggcgcacgggtgagtaaggtatagttaatctgccctacacaagaggacaacagttggaaacgactgctaatactctatactcctgcttaacacaagttgagtagggaaagtttttcggtgtaggatgagactatatagtatcagctagttggtaaggtaatggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtacactagttgttgggatgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2414 - DNA, 1517 bp, Campylobacter sp. P255
  ref <308>: DATABASE ACCESSION NUMBER: NCBI ACCESSION: NZ_NREN01000020.1
  ref <309>: DATABASE ENTRY DATE: 2019-04-01
  ref <313>: RELEVANT RESIDUES IN SEQ ID NO: (1)..(1517)
tttatggagagtttgatcctggctcagagtgaacgctggcggcgtgcctaatacatgcaagtcgaacgatgaagcttttagcttgctagaagtggattagtggcgcacgggtgagtaaggtatagttaatctgccctacacaagaggacaacagttggaaacgactgctaatactctatactcctacttaacacaagttgagtagggaaagttttttcggtgtaggatgagactatatagtatcagctagttggtgaggtaatggctcaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttcttagggaagaattctgacggtacctaaggaataagcaccggctaactccgtgccagcagccgcggtaatacggagggtgcaagcgttactcggaatcactgggcgtaaagggcgcgtaggcggattatcaagtctcttgtgaaatccaacggcttaaccgttgaactgcttgggaaactggtagtctagagtgagggagaggcagatggaattggtggtgtaggggtaaaatccgtagatatcaccaagaatacccattgcgaaggcgatctgctggaacttaactgacgctaaggcgcgaaagcgtggggagcaaacaggattagataccctggtagtccacgccctaaacgatgtacactagttgttggggtgctagtcatctcagtaatgcagctaacgcattaagtgtaccgcctggggagtacggtcgcaagattaaaactcaaaggaatagacggggacccgcacaagcggtggagcatgtggtttaattcgaagatacgcgaagaaccttacctgggcttgatatcctaagaaccttatagagatatgagggtgctagcttgctagaacttagagacaggtgctgcacggctgtcgtcagctcgtgtcgtgagatgttgggttaagtcccgcaacgagcgcaacccacgtatttagttgctaacggttcggccgagcactctaaatagactgccttcgtaaggaggaggaaggtgtggacgacgtcaagtcatcatggcccttatgcccagggcgacacacgtgctacaatggcatatacaatgagacgcaataccgcgaggtggagcaaatctataaaatatgtcccagttcggattgttctctgcaactcgagagcatgaagccggaatcgctagtaatcgtagatcagccatgctacggtgaatacgttcccgggtcttgtactcaccgcccgtcacaccatgggagttgatttcactcgaagccggaatactaaactagttaccgtccacagtggaatcagcgactggggtgaagtcgtaacaaggtaaccgtaggagaacctgcggttggatcacctcctttcta

SEQ ID NO: 2415 - DNA, 1815 bp, Campylobacter sputorum
  ref <308>: DATABASE ACCESSION NUMBER: NCBI ACCESSION: NZ_UFVD01000001.1
  ref <309>: DATABASE ENTRY DATE: 2019-04-01
  ref <313>: RELEVANT RESIDUES IN SEQ ID NO: (1)..(1815)
ctttaggtgggtcaagggagtgtttacactccctgtcgcaaagattagctttgctaatctgcgaagtaaatatggagagtttgatcctggctcagagtgaacgctggcggcgtgcctaatacatgcaagtcgaacgatgaagtcctagcttgctaggatggattagtggcgcacgggtgagtaatgtatagctaatctgccccatagagaggaacaacacttagaaatgagtgctaatacctcatactccaattatacataagtttaattgggaaatgtagctcttaataatatatatcaaagataatttataaataaaaagttataaatataacaataagcttttttgaagctttatattaataaagcgaaaaaaaagcaaagcagttagatttaataaatttttatagcatttaaaaatacaaaagacttaatttttaaatctaaatataaattattactaatatttttaatagtcatttagaaatatcttaatatatattattaagagctttcgctatgggatgaggctatattgtatcagctagttggtaaggtaatggcttaccaaggctatgacgcataactggtctgagaggatgatcagtcacactggaactgagacacggtccagactcctacgggaggcagcagtagggaatattgctcaatgggggaaaccctgaagcagcaacgccgcgtggaggatgacacttttcggagcgtaaactccttttctttgggaagaataatgacggtaccaaaggaataagcaccggctaactccgtgccagcagccgcggtaatacggagggtgcaagcgttactcggaatcactgggcgtaaaggacgcgtaggtggatagataagtctcttgtgaaatctagtagcttaactactaaactgcttgggaaactatctatctagagtaagggagaggcagatggaattcttggtgtaggggtaaaatccgtagatatcaagaggaatacttattgcgaaggcgatctgctagaacttaactgacactaatgcgtgaaagcgtggggagcaaacaggattagataccctggtagtccacgccctaaacgatgtatactggttgttgctgtgctagtcatggcagtaatccacctaacggattaagtataccgcctggggagtacggtcgcaagattaaaactcaaaggaatagacggggacccgcacaagcggtggagcatgtggtttaattcgaagatacgcgaagaaccttacccggacttgatatctaacaaatcatctagagatagaagagtgtctgcttgcagaaatgttaagacaggtgctgcacggctgtcgtcagctcgtgtcgtgagatgttgggttaagtcccgcaacgagcgcaacccacgtgtttagttgctaacagttaggctgagcactctaaacagactgccttcgtaaggaggaggaaggtgtggacgacgtcaagtcatcatggcccttatgtccggggcgacacacgtgctacaatggcatatacaataagacgcaatatcgcgagatggagcaaatctataaaatatgtcccagttcggattggagtctgcaactcgactccatgaagccggaatcgctagtaatcgtagatcagccatgctacggtgaatacgttcccgggtcttgtactcaccgcccgtcacaccatgggagttgatttcactcgaagcccaaataccaaattggttatggtccacagtggaatcagcgactggggtgaagtcgtaacaaggtaaccgtaggagaacctgcggttggatcacctcctttcta

SEQ ID NO: 2416 - DNA, 1514 bp, Campylobacter upsaliensis
  ref <308>: DATABASE ACCESSION NUMBER: NCBI ACCESSION: NZ_LR134372.1
  ref <309>: DATABASE ENTRY DATE: 2019-04-01
  ref <313>: RELEVANT RESIDUES IN SEQ ID NO: (1)..(1514)
tatggagagtttgatcctggctcagagtgaacgctggcggcgtgcctaatacatgcaagtcgaacgatgaagcttttagcttgctagaagtggattagtggcgcacgggtgagtaaggtatagttaatctgccctacactgggggacaacacttagaaatgagtgctaataccccatactcctacctaacataagttagatagggaaagtttttcggtgtaggatgagactatatagtatcagctagttggtaaggtaaaggcttaccaaggctatgacgcttaactggtctgagaggatgatcagtcacactggaactgagacacggtccagactcctacgggaggcagcagtagggaatattgcgcaatgggggaaaccctgacgcagcaacgccgcgtggaggatgacacttttcggagcgtaaactccttttctttgggaagaattttgacggtaccaaaggaataagcaccggctaactccgtgccagcagccgcggtaatacggagggtgcaagcgttactcggaatcactgggcgtaaagggcgcgtaggcggattatcaagtctcttgtgaaatctaatggcttaaccattaaactgcttgggaaactgatagtctagagtgagggagaggcagatggaattggtggtgtaggggtaaaatccgtagatatcaccaagaatacccattgcgaaggcgatctgctggaactcaactgacgctaaggcgcgaaagcgtggggagcaaacaggattagataccctggtagtccacgccctaaacgatgtatgctagttgttggggtgctagtcatctcagtaatgcagctaacgcattaagcataccgcctggggagtacggtcgcaagattaaaactcaaaggaatagacggggacccgcacaagcggtggagcatgtggtttaattcgaagctacgcgaagaaccttacctaggcttgatatccaacaaattctgtagagatacggaagtgctagcttgctagaatgttgagacaggtgctgcacggctgtcgtcagctcgtgtcgtgagatgttgggttaagtcccgcaacgagcgcaaccctcgtccttagttgctaacgattcggtcgagcactctaaggagactgccttcgtaaggaggaggaaggtggggacgacgtcaagtcatcatggcccttacgcctagggcgacacacgtgctacaatggcatatacaatgagacgcaataccgcgaggtggagcaaatctataaaatatgtcccagttcggattgttctctgcaactcgagagcatgaagccggaatcgctagtaatcgcaaatcagccatgttgcggtgaatacgttcccgggtcttgtactcaccgcccgtcacaccatgggagttgatttcactcgaagtggaaatactaaactagttatcccccacagtggaatcagcgactggggtgaagtcgtaacaaggtaaccgtaggagaacctgcggttggatcacctcctttcta

SEQ ID NO: 2417 - DNA, 1515 bp, Campylobacter ureolyticus
  ref <308>: DATABASE ACCESSION NUMBER: NCBI ACCESSION: NZ_UFUU01000002.1
  ref <309>: DATABASE ENTRY DATE: 2019-04-01
  ref <313>: RELEVANT RESIDUES IN SEQ ID NO: (1)..(1515)
tttatggagagtttgatcctggctcagagtgaacgctggtggcgtgcctaatacatgcaagtcgaacgatgaagtcctagcttgctaggatggattagtggcgcacgggtgagtaatatatagttaatctgccctacacagaggaacaacagttggaaacgactgctaatacctcatactcctatttaacataagttaaatagggaaagtcttttcggtgtaggatgagactatatcgtatcagctagttggtaaggtaatggcttaccaaggctatgacgcgtaactggtctgagaggatgatcagtcacattggaactgagacacggtccaaactcctacgggaggcagcagtaaggaatattgcgcaatgggggaaaccctgacgcagcaacgccgcgtggaggatgacacttttcggagcgtaaactccttttatcaggaaagaataatgacggtacctgatgaataagcaccggctaactccgtgccagcagccgcggtaatacggggggtgcaagcgttactcggaatcactgggcgtaaaggacgcgtaggcggattatcaagtcttttgtgaaatctagtggcttaaccactaaactgcttaggaaactgatagtctagagtaggggagaggtagatggaattcttggtgtaggggtaaaatccgtagagatcaagaagaatacccattgcgaaagcgatctgctggaacctaactgacgctgaggcgtgaaagcgtgggtagcaaacaggattagataccctggtagtccacgccctaaacgatgtatactagttgttgctttgctagtcaaggcagtaatgcagctaacgcattaagtataccgcctggggagtacggtcgcaagattaaaactcaaaggaatagacggggacccgcacaagcggtggagcatgtggtttaattcgaagatacgcgaagaaccttacctggacttgacatcctaaaaacatctaagagattagaaagtgctagtttactagaatttagtgacaggtgctgcacggctgtcgtcagctcgtgtcgtgagatgttgggttaagtcccgcaacgagcgcaacccacgtgtttagttgctaacagctcggctgagcactctaaacagactgccttcgcaaggaggaggaaggtgtggacgacgtcaagtcatcatggcccttatgtccagggcgacacacgtgctacaatgacatatacagtaagacgcaatatcgcaagatggagcaaatctataaaatatgtcccagttcggattggggtctgcaactcgaccccatgaagccggaatcgctagtaatcgtagatcagccatgctacggtgaatacgttcccgggtcttgtactcaccgcccgtcacaccatggaagttgatctcactcgaagcagggatgctaaaatagctaccttccacagtggaatcagtaactggggtgaagtcgtaacaaggtaaccgtaggagaacctgcggttggatcacctcctttcta

SEQ ID NO: 2418 - DNA, 1591 bp, Candiadtus Scalindua japonica
  ref <308>: DATABASE ACCESSION NUMBER: NCBI ACCESSION: NZ_BAOS01000029.1
  ref <309>: DATABASE ENTRY DATE: 2019-04-01
  ref <313>: RELEVANT RESIDUES IN SEQ ID NO: (1)..(1591)
atgagtacaatattaaatttatgaagggtttgatcttggctcagaacgaacgctggcggcgtggattaggcatgcaagtcgaacgaggatatatccttcgggatgtaagccgagtggcgcaagggtgagtaatgcatagattacctgcctctaggataaggacaactttgtgaaaacggagctaatacttaataatacaagagaaaataatattcttttgtcaatgggagggtagcaatatcttttgcctggagaggggtttatgtcctatcagcttgttggtggggtaatggcctaccaaggcttagacgggtagccggccttagagggtggtcggccacactgggactgagacactgcccagacttctacggaaggctgcagtcgagaatctttcgcaatgcccgaaagggtgacgaagcgacgccgcgtgggtgaggaaggccttcgggttgtaaagccctgtcaggagttaagaaatataagtgtgctaataccacatttatttgacgaaggctccaaaggaagccacggctaactctgtgccagcagccgcggtaatacagaggtggcaagcgttgttcggaattattgggcgtaaagagcacgtaggtgggtttgtaagtcagatgtgaaagccttctgttcaacgggagaattgcatctgaaactgtaaatcttgagtgtaggaggggagaatggaacttctggtggagcggtgaaatgcgtagatatcagaaggaacgccggcggcgaaagcgattctctggcctattactgacactcagtgtgcgaaagctaggggagcaaacgggattagataccccggtagtcctagccgtaaacgatgggcactaagtagagggaattaccgatgttctctctgccgtagctaacgcattaagtgccccgcctggggagtacggccgcaaggctaaaactcaaaagaattgacgggggctcgcacaagcggtggagcatgtggcttaattcgatgcaacgcgaaaaaccttaccggggcttgacatggtagaagtaggaacccgaaagggtaacgaacggtatccagtccgtagctatcacaggtgttgcatggctgtcgtcagctcgtgtcgtgagacgttgggttaagtcccctaacgagcgaaacccttgtttttagttaccagcgggttgtgccgggtactctagaaagactgccgtcgtcaagacggaggaaggtggggatgacgtcaagtcatcatggcccttatgccccgggctgcacacgtgctacaatggtcggtacaaacggaagcgaagccgtaaggtggagcgaatcctaaaaagccgatctcagttcggattggaggctgaaattcgcctccatgaagttggaatcgctagtaatcgcggatcagcagtgccgcggtgaatatgttcccgagccttgtacacaccgcccgtcaagccacccaagcaggatgcacccgaaaacattatatctaaccagggtaacttggaggaaaatgttgaaggagtgttttgtgaggaggactaagtcgtaacaaggtagtcgtaggagaacctgcggctggatcacctcctttct

SEQ ID NO: 2419 - DNA, 1543 bp, Candidatus Accumulibacter phosphatis
  ref <308>: DATABASE ACCESSION NUMBER: NCBI ACCESSION: NC_013194.1
  ref <309>: DATABASE ENTRY DATE: 2019-04-01
  ref <313>: RELEVANT RESIDUES IN SEQ ID NO: (1)..(1543)
ttgaactgaagagtttgatcctggctcagattaaacgctggcggcatgccttacacatgcaagtcgaacggcagcacgggggcaaccctggtggcgagtggcggacgggtgagtaaagcatcggaacgtatcctggagtgggggataacgtagcgaaagttacgctaataccgcatattctgtgagcaggaaagcaggggatcgcaagaccttgcgctctgggagcggccgatgtcggattagctagttggtggggtaaaggcctaccaaggcgacgatccgtagcgggtctgagaggatgatccgccacactgggactgagacacggcccagactcctacgggaggcagcagtggggaattttggacaatgggcgcaagcctgatccagccatgccgcgtgagtgaagaaggccttcgggttgtaaagctctttcggcggggaagaaattgcacgggttaataccctgtgtagatgacggtacccgaataagaagcaccggctaactacgtgccagcagccgcggtaatacgtagggtgcgagcgttaatcggaattactgggcgtaaagcgtgcgcaggcggtttggtaagtcagatgtgaaatccccgggctcaacctgggaactgcatttgagactgccaggctggagtttggcagaggggggtggaattccacgtgtagcagtgaaatgcgtagagatgtggaggaacaccgatggcgaaggcagccccctgggccaatactgacgctcatgcacgaaagcgtggggagcaaacaggattagataccctggtagtccacgccctaaacgatgtcaactaggtgttgggagggttaaaccttttagtgccgtagctaacgcgtgaagttgaccgcctggggagtacggccgcaaggctaaaactcaaaggaattgacggggacccgcacaagcggtggatgatgtggattaattcgatgcaacgcgaaaaaccttacctacccttgacatgtcaggaatcccgaagagatttgggagtgctcgcaagagagcctgaacacaggtgctgcatggctgtcgtcagctcgtgtcgtgagatgttgggttaagtcccgcaacgagcgcaacccttgtcattaattgccatcattcagttgggcactttaatgagactgccggtgacaaaccggaggaaggtggggatgacgtcaagtcctcatggcccttatgggtagggcttcacacgtcatacaatggtcggtccagagggttgccaacccgcgagggggagccaatctcagaaagccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtaggggaacctgcggctggatcacctcctttcta

SEQ ID NO: 2420 - DNA, 1519 bp, Candidatus Amoebophilus asiaticus
  ref <308>: DATABASE ACCESSION NUMBER: NCBI ACCESSION: NC_010830.1
  ref <309>: DATABASE ENTRY DATE: 2019-04-01
  ref <313>: RELEVANT RESIDUES IN SEQ ID NO: (1)..(1519)
atggagagtttgatcctggctcaggatgaacgctagcggcaggcctcatacatgcaagtcgaggggcagcaggacacttcggtgttgctggcgaccggcgcacgggtgcgtaacacgtatgcaatctaccttgtactggagcatagctctcggaaacgagaattaatactccatatgatctcattaacacatgttagagagatgaaagctccggcggtacaagatgagcatgcgtcccattagctagttggtgaggtaacggctcaccaaggcgacgatgggtaggggttctgagaggaagatcccccacactggcactgagatacgggccagactcctacgggaggcagcagtagggaatattggtcaatgggcgcaagcctgaaccagccatgccgcgtgcaggatgaaggccctcagggttgtaaactgcttttatatggaaataaaaagcccttgcgagggttattgaaggtaccataagaataagcaccggctaactccgtgccagcagccgcggtaatacggagggtgcaagcgttatccggatttactgggtttaaagggtgcgtaggcggctctttaagtcagtggtgaaagcctagtgcttaacactagaattgccattgaaactgaagagcttgagtcaaggagaggtaagcagaatttatggtgtagcagtgaaatgcttagataccataaggaataccaatagcgaaggcagcttactggccttgcactgacgctgaggcacgaaagcgtggggagcaaacaggattagagaccctggtagtccacgctgtaaacgatgatcactcgatatacatacttgatatgtgtgtctgagcgaaagcattaagtgatccacctggggagtacgcccgcaagagtgaaactcaaaggaattgacgggggtccgcacaagcggtggagcatgtggtttaattcgatagtacgcgaggaaccttacctgggctagaatgcttctgcaaccttgagaaatcgagggttccttcgggacagaatgcaaggtgctgcatggccgtcgtcagctcgtgccgtgaggtgttgggttaagtcccataacgagcgcaacccttttacttagttgccagcatgtaatgatggggactctaagtagactgcctgcgtaagcaggaggaaggaggggatgaggtcaggtcatcatggctcttacgcccagggctacacacgtgctacaatggcgtgtacagaaggatgctacttggtaacaagcggccaatcccaaaagcacgtctcagttcggattgaggtctgcaactcgacctcatgaagttggaatcgctagtaatcgcgtatcagcaacgacgcggtgaatacgttctcggaccttgtacacaccgcccgtcaagccatgggagttggtaggacctgaagacagtgaccgtaaaaggagctgtttagggttagatcagcgactggggctaagtcgtaacaaggtagccgtaccggaaggtgcggctggaatacctccttt

SEQ ID NO: 2421 - DNA, 1488 bp, Candidatus Atelocyanobacterium thalassa
  ref <308>: DATABASE ACCESSION NUMBER: NCBI ACCESSION: NC_013771.1
  ref <309>: DATABASE ENTRY DATE: 2019-04-01
  ref <313>: RELEVANT RESIDUES IN SEQ ID NO: (1)..(1488)
tatggagagtttgatcctggctcaggatgaacgctggcggtatgcctaacacatgcaagtcgaacgatgtcttcggacatagtggcggacgggtgagtaacgcgtgagaatctgcctctaggatggggataacggttggaaacgaccgctaacacccaatatgccgtaaggtgaaaaatttattgcctggagaggagctcgcgtctgattagctagttggtggggtaagagctcaccaaggcttcgatcagtagctggtctgagaggatgagcagccacactgggactgagacacggcccagactcctacgggaggcagcagtggggaattttccgcaatgggcgaaagcctgacggagcaataccgcgtgagggaggaatgcctttgggttgtaaacctcttttctcagggaagaagatctgacggtacctgaggaataagtatcggctaactccgtgccagcagccgcggtaatacggaggatgcaagcgttatccggaatcattgggcgtaaagcgtccgcaggtggtttccaaagtctgctgttaaagactggagctcaactccggaacggcggtggaaacttggaaactagagttcggtaggggtagcaggaattcccagtgtagcggtgaaatgcgtagatattgggaagaacatcggtggcgaaggcgtgctactggaccgtaactgacactcagggacgaaagctaggggagcgaaagggattagatacccctgtagtcctagctgtaaacgatggaaactaggtgtggcttgtatcgacccgagccgtgccgtagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatctcggtgaaagctgagagtgccttcgggagcgcgaacacaggtggtgcatggctgtcgtcagctcgtgtcgtgagatgttgggttaagtcccgcaacgagcgcaacccttatttttagttgccagcattaagatgggcactctagaaagactgccggtgacaaaccggaggaaggtgaggacgacgtcaagtcagcatgccccttacgccctgggctacacacgtactacaatggttgggacaaagggcagcgactccgcaaggaatagcgaatctcatcaaacccagcctcagttcagattgcaggctgcaactcgcctgcatgaaggaggaatcgctagtaatcgcaggtcagcatactgcggtgaattcgttcccgggccttgtacacaccgcccgtcacaccatggaagctggtcacgcccgaagtagttaccctaacctttcgaggagggggattcctaaggcagggctagtgactggggtgaagtcgtaacaaggtagccgtaccggaaggtgtggctggatcacctccttat

SEQ ID NO: 2422 - DNA, 1601 bp, Candidatus Brocadia sapporoensis
  ref <308>: DATABASE ACCESSION NUMBER: NCBI ACCESSION: NZ_MJUW02000026.1
  ref <309>: DATABASE ENTRY DATE: 2019-04-01
  ref <313>: RELEVANT RESIDUES IN SEQ ID NO: (1)..(1601)
ttttatgaagggtatgatcttggctcagaacgaacgctggcggcgtggattaggcatgcaagtcgaacgagggagcgtcccgaaagggatgcaaaccgagtggcgtaagggtgagtaatgcattgataacctacctccaagatgggaataacaacgttccaagcaattggggctaccgaaagggttgctaatactcaataaaattattgttgcttcggcaataatagtcaaataggaggaatcgaaaggttccgcttgcttgaagaggggtcaatgtcctatcagctagttggtggggtaatagcctaccaaggcgaagacgggtagccggcctgagagggtggtcggccacactgggactgagatactgcccagactcctacgggaggctgcagtcgagaatctttcgcaatgcccgaaagggtgacgaagcgacgccgcgtgtgggaagaaggccttcgggttgtaaaccactgtcgggagttaggaaatgcaggtgcgttaatagcgcacttgcttgactaaggctccagaggaagccacggctaactctgtgccagcagccgcggtaatacagaggcggcaagcgttgttcggaattattgggcgtaaagagcacgtaggcggctgtgtaagtcggttgtgaaagccttccgctcaacggaagaacggcatccgatactgcatggcttgagtgtgggaggggagagtggaacttctggtggagcggtgaaatgcgtagatatcagaaggaacaccggcggcgaaggcgactctctggtccataactgacgctgagtgtgcgaaagctaggggagcaaacgggattagataccccggtagtcctagccgtaaacgatgggcactaagtagaggggttttgattatctctctgccggagctaacgcattaagtgccccgcctggggagtacggccgcaaggctaaaactcaaaagaattgacgggggctcgcacaagcggtggagcatgtggcttaattcgatgcaacgcgaagaaccttaccggggtttgacatggtagaagtagaagcctgaaaaggtgacgaacggtatccagtccgtaactatcacaggtgttgcatggctgtcgtcagctcgtgtcgtgagacgttgggttaagtcccctaacgagcgaaacccttgtctttagttgccaacagataatgctgggcactctaaagaaactgccgtcgtcaagacggaggaaggtggggatgacgtcaagtcatcatggcccttatatcccgggctgcacacgtgctacaatggtcggtacaaagggatgctaagccgtaaggtggagcgaaacccagaaagccgatcccagttcagattggaggctgaaacccgcctccatgaagtaggaatcgctagtaatcgcggatcagctacgccgcggtgaatatgttcccgagccttgtacacaccgcccgtcaagccacccaagcaagatgcacccaaaatcaccggcctaacctgaaaaggaaggaagtgcctaaggtgtgttttgtgaggaggactaagtcgtaacaaggtagtcgtaggagaacctgcggctggatcacctcctttctaaggag

SEQ ID NO: 2423 - DNA, 1593 bp, Candidatus Brocadia sinica
  ref <308>: DATABASE ACCESSION NUMBER: NCBI ACCESSION: NZ_BAFN01000001.1
  ref <309>: DATABASE ENTRY DATE: 2019-04-01
  ref <313>: RELEVANT RESIDUES IN SEQ ID NO: (1)..(1593)
ttatgaagggtatgatcttggctcagaacgaacgctggcggcgtggattaggcatgcaagtcgcacgagggagcgtcccgaaaggggcgcaaaccgagtggcgtaagggtgagtaatgcattgataacctacctttgagatgggaacaacaacgttccaagtaattggggctaccgaaagggttgctaattctcaataaaaatgctgacactttggtgtcggcagtcaaagaaatggatctgaaaaggtccatttgctcagagaggggtcaatgtcctatcagctagttggtagggtaatggcctaccaaggcgaagacgggtagccggcctgagagggtggtcggccacactgggactgagacactgcccagactcctacgggaggctgcagtcgagaatctttcgcaatgcccgaaagggtgacgaagcgacgccgcgtgtgggatgaaggccttcgggttgtaaaccactgtcgggagttaagaattgtaggaatgctaatagtatttctacttgactaaggctccggaggaagccacggctaactctgtgccagcagccgcggtaatacagaggcggcaagcgttgttcggaattattgggcgtaaagagcatgtaggcggctatgtaagtcggttgtgaaagccttccgcttaacggaagaatggcggtcgaaactgcatggcttgagtgcgggaggggagagtggaacttctggtggagcggtgaaatgcgtagatatcagaaggaacgtcggcggcgaaagcgactctctagaccgtaactgacgctgagtgtgcgaaagctaggggagcaaacgggattagataccccggtagtcctagccgtaaacgatgggcactaagtagaggggttttgattatctctctgccggagctaacgcattaagtgccccgcctggggagtacggccgcaaggctaaaactcaaaagaattgacgggggctcgcacaagcggtggagcatgtggcttaattcgatgcaacgcgaagaaccttaccggggcttgacatgatagaagtaggaacccgaaagggcgacgaacggtatccagcccgaaactatcacaggtgttgcatggctgtcgtcagctcgtgtcgtgagacgttgggttaagtcccctaacgagcgaaacccttgtctttagttgccatcaggttatgctgggcactctaaagagactgctgtcgtcaagacggaggaaggtggggatgacgtcaagtcatcatggcccttatgtcccgggctgcacacgtgctacaatggttggtacaaagggatgctaaactgtaaagcggagcgaaacccataaaaccgatctcagttcagattggaggctgaaacccgcctccatgaagtaggaatcgctagtaatcgcggatcagctacgccgcggtgaatatgttcccgagccttgtacacaccgcccgtcaagccacccaagcaagatgcacccaaaatcgctggccaaacccgtaagggatggaagtgcttaaggtgtgttttgtgaggaggactaagtcgtaacaaggtagtcgtaggagaacctgcggctggatcacctcctttct

SEQ ID NO: 2424 - DNA, 1530 bp, Candidatus Cardinium hertigii
  ref <308>: DATABASE ACCESSION NUMBER: NCBI ACCESSION: NZ_RARA01000026.1
  ref <309>: DATABASE ENTRY DATE: 2019-04-01
  ref <313>: RELEVANT RESIDUES IN SEQ ID NO: (1)..(1530)
atagaaagaagagtttgatcctggctcaggataaacgctagcggcaggcctcatacatgcaagtcgaggggcagcggaacacttcggtgttgccggcgaccggcgcacgggtgcgtaatgcgtatgcaatctactttacactggggcatagcttccggaaacggaaattaataccccatataatcttattaacgcctgttaaaaagatgaaagctccggcggtgtaaaatgagcatgcgtcctattagctagttggagaggtaatggctcaccaaggcgatgatgggtaggggttcttagtggaaggtcccccacactggcactgagatacgggccagactcctacgggaggcagcagtagggaatattggtcaatgggcgcaagcctgaaccagccatgccgcgtgcaggatgaaggctctctgagttgtaaactgcttttgtataggaacaaaaaagcttctgcggaggttcttgagggtactataagaataagcaccggctaattccgtgccagcagccgcggtaatacggaaggtgcaagcgttatccggttttattgggtttaaagggtgcgtaggcggtttattaagtcagttgtgaaatcctagtgcttaacgctagaactgcaattgatactggtagacttgagttaagaagaggtaagtagaatttatggtgtagtagtgaaatgcttagatatcataaggaataccaatagcgtaggcagcttactggtctttaactgacgctgaggcacgaaagcgtggggagcaaacaggattagataccctggtagtccacgccgtaaacgatgatcactagatatgcacgatatatcgtgtgtgttcaagcgaaagcgttaagtgatccacctggggagtatactcgcaagggtgaaactcaaaggaattgacgggggtccgcacaagcggtggagtatgtggtttaattcgttaatccgcgaggaaccttacctgggctagaatgtattttgcaacctcgagaaattgagggttccttcgggacggaatacaaggtgctgcatggctgtcgtcagctcgtgccgtgaggtgttgggttaagtcctataacgagcgcaacccttttacttagttgccagcacgtaatggtggggactttaagtagactgcccgtgtaagcgggaggaaggagaggatgaggtcaagtcatcatggcctttatgcccagggctacacacgtactacaatggcatgtacagaaggaagctacttggtaacaagatgcaaatcttaaaagcatgtctcagttcggattggggtctgcaattcgaccccatgaagttggaatcgctagtaatcgcgtatcagcaatgacgcggtgaatacgttctcggaccttgtacacaccgcccatcaagccatgggagttggtagagcttgaagacagtggccgtaaaaggagctgtttagtgttagaccagcgactggggctaagttgtaacaaggtagccgtaccggaaggtgtggctggaacacctcctttata

SEQ ID NO: 2425 - DNA, 1556 bp, Candidatus Chlamydia corallus
  ref <308>: DATABASE ACCESSION NUMBER: NCBI ACCESSION: NZ_NWQK01000001.1
  ref <309>: DATABASE ENTRY DATE: 2019-04-01
  ref <313>: RELEVANT RESIDUES IN SEQ ID NO: (1)..(1556)
ttttctgagaatttgatcttggttcagattgaacgctggcggcgtggatgaggcatgcaagtcgaacggaataatgacttcggttgttatttagtggcggaagggttagtaatacatagataatctgccctcaacttgggaataacggttggaaacgatcgctaataccgaatatagtatatttaggcatctaataatattaaagaaggggatcttcggacctttcggttgaggaagagtttatgcgatatcagcttgttggtagggtaaaagcctaccaaggctatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggccttagggttgtaaagcactttcgcctgggaataagagagattggctaatatccaatcaatttgagcgtaccaggtaaagaagcaccggctaactccgtgccagcagctgcggtaatacggagggtgctagcgttaatcggatttattgggcgtaaagggcgtgtaggcggaaaggaaagttagatgttaaattttggggctcaaccccaagtcagcatttaaaactatctttctagaggatagatggagaaaagggaattccacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatctgtgtcggagctaacgtgttaagtatgccgcctgaggagtacactcgcaagggtgaaactcaaaagaattgacgggggcccgcacaagcagtggagcatgtggtttaattcgatgcaacgcgaaggaccttacctggacttgacatgtatttgacagctgtagaaatacagtcttccgcaaggacagatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgtccagggcgacacacgtgctacaatggttagtacagaaggtagcaagatcgtgagatggagcaaatcctaaaagctaaccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacctatttataggagagaggcgcccaaggtgaggctgatgactgggatgaagtcgtaacaaggtagccctaccggaaggtggggctggatcacctccttttta

SEQ ID NO: 2426 - DNA, 1485 bp, Candidatus Chloroploca sp. Khr17
  ref <308>: DATABASE ACCESSION NUMBER: NCBI ACCESSION: NZ_RYFF01000147.1
  ref <309>: DATABASE ENTRY DATE: 2019-04-01
  ref <313>: RELEVANT RESIDUES IN SEQ ID NO: (1)..(1485)
acgcagagtttgatcctggctcaggacgaacgctggcggcgtgcctaatgcatgcaagtcggacgcagggtgcttgcaccgctgcgtggcgcacggctgaggaacacgtgggtacctgccccggagtgggggataccccgtcgaaagacgggacaagcccgcatacggtccgcaaggaagaaagccgaaaggcgctctgggaggggcctgcggcccatcaggttgttggtgtggtaagagcgcaccaagccgatgacgggttcctggtctgagaggacgaccaggcagactgggactgagacacggcccagactcctacgggaggcagcagcaaggaattttccccaatgggcgcaagcctgagggagcaacgccgcgtgcaggacgacggccttcgggttgtaaactgcttttgggcgggacgataatgacggtaccgtccgaagaagccccggctaactccgtgccagcagccgcggtaagacggagggggcaagcgttgtccggacttactgggcgtaaagcgcacgtaggcggcgtggtgcgtcggtgctgaaagcgccaggcttaacctggcgaggcgtgccgatacgaccatgctagaggcaggcagagggtggcggaattccgggtgtagtggtgaaatgcgtagagatccggaggaacgccggtggggaagccggccacctgggcctgacctgacgctgaggtgcgaaagcgtggggagcaaaccggattagatacccgggtagtccacgcagtaaacgatgctagctcggtgtctgaggctcgttcgagccttgggtgcctaagcacacgcggtaagctagccgcctggggactacgagcgcaagcttaaaactcaaaggaattgacgggggcccgcacaagcagcggagcgtgtggtttaattcgacgcaacgcgaaacaccttacccaggcttgacatgcagctgcagacggcggaaacgtcgtcgccttcgagggtgctgcacaggtgctgcatggctgtcgtcagctcgtgtcgtgagatgttgggttcagtcccgcaacgagcgcaacccgcatcggtagttaccagtgtctaccgagacagccgccttgatgggcggaggaaggcgcggatgacgtcaagtcagcatggcccttacgcctggggcaacacacacgctacaatggccgggacagtgcgtcgccacgccgtaaggcggagcaaatcgacaaacccggccccagttcagatcgagggctgcaactcgccctcgtgaaggcggagttgctagtaaccgcgtatcagcgatggcgcggtgaatgcgttcccgggccttgtacacaccgcccgtcacgtcatgggagtggccaatgcttgaagtccgtgggctaacccttcggggaggcagcggccgagggcaggggtcgcgactgggacgaagtcgtaacaaggtatccgtaccggaaggtgcggatggatcacctcctttctag

SEQ ID NO: 2427 - DNA, 1560 bp, Candidatus Chrysopegis kryptomonas
  ref <308>: DATABASE ACCESSION NUMBER: NCBI ACCESSION: NZ_CZVW01000013.1
  ref <309>: DATABASE ENTRY DATE: 2019-04-01
  ref <313>: RELEVANT RESIDUES IN SEQ ID NO: (1)..(1560)
acaacggagagtttgatggtggctcagggcgaacgctggcggcgtgcctaacacatgcaagtcagggacgtgaggtgtagcaatacacttcacggaccggcgcacgggtgagtaacgcgtaggtaacctacccacaggttcgggataacaccgagaaatcggtgctaataccggatgatgtcccgatatcgcatgatatcgggattaaaggtggcctgaaagggctaccgcctgtggatgggcctgcgtcctatcaggtagttggtggggtaatggcccaccaagcctatgacgggtagccggcctgagagggtggtcggccacacggggactgagacacggccccgactcctacgggaggcagcagtgaggaatcttgggcaatgcccgaaagggtgacccagcgacgccgcgtgagggaagaagcccgtgagggtgtaaacctctgtggagggggaagaaaatcctgggttcgaataggactcagggctgacggtacccctctagaaagccccggctaactacgtgccagcagccgcggtaatacgtagggggcgagcgttgcccggaatcactgggcgtaaagggtacgcaggcgggcctgtaagtcaagggtgaaattccggggctcaactccggagctgcccttgagactgcaggtcttgggtgcggaagagggaggtggaattcccggtgtagcggtgaaatgcgtagatatcgggaggaacaccggtggcgaaggcggcctcctggtccgcaaccgacgctcaggtacgaaagcgtggggagcaaacaggattagataccctggtagtccacgccctaaacgttgggtgctaggtgttggccctttagggtcagtgccgaagctaacgcgataagcaccccgcctggggagtatacccgcaagggtgaaactcaaaccaattgacgggggcccgcacaagcggtggagcatgtggtttaattcgatgcaacgcgaagaaccttacctgggcttgacatgccggtagtaggagcccgaaagggtgacgacccgtaaagtcgggagccggcacaggtgctgcatggctgtcgtcagctcgtgccgtgaggtgttgggttaagtcccgcaacgagcgcaacccctgtccctagttgccagcgggtaaagccgggcactctagggagactgccagcgcaagctggaggaaggtggggatgacgtcaagtcctcatggcccttatgtccagggctacacacgtgctacaatgccggctacagcgggttccgaagccgcgaggcggaggcaatccctaaaaagccggcccagttcggatcgcagtctgcaactcgactgcgtgaagtcggaatcgctagtaatcgcgcatcagcacggcgcggtgaatacgttcccgggccttgtacacaccgcccgtcacgccatgggagccgggggcacccgaagtcgccgagctaaccccgaaaggggaggcaggcgccgaaggtgaaaccggtgactggggcgaagtcgtaacaaggtagccgtaccggaaggtgcggctggatcacctcctttt

SEQ ID NO: 2428 - DNA, 687 bp, Candidatus Cryosericum hinesii
  ref <308>: DATABASE ACCESSION NUMBER: NCBI ACCESSION: NZ_QXIX01000058.1
  ref <309>: DATABASE ENTRY DATE: 2019-04-01
  ref <313>: RELEVANT RESIDUES IN SEQ ID NO: (1)..(687)
tttcgaagagttcgatcctggctcagaatgaacgctggcggcgtgctttacacatgcaagtcgagcggagaccttgtcgaagggcaaccggagatgatgtctcagcggcaaacgggtgagtaatggacaggtaacgtaccccctagacgtggatagctcatcgaaagatgagataatacgcgataatgttgcagggcgatggctctgcaaagaaagcgggcgcaagctcgcgcttccggatcggcctgtctcctatcagctagttggtggggtaatagcctaccaaggcgatgacgggtagctggtctaagaggatggtcagccacattggaactgcgatacggtccagactcctacgggaggcagcagtggggaatcatggtcaatgggcgaaagcctgaacctgcgacgccgcgtgagtgatgaaggtcgtaagatcgtaaaactcttttcagagagattaaagctccggctctaacatagcctggagtatgactatctctggaataagccccagccaactacgtgccagcagctgcggtaatacgtagggggcgagcgttattcggaattactgggtgtaaagggtatgtaggcggcctcacaagtcgcgtgtaaaagtccagcgctcaacgctgggttcgcacgtgatactgtaaggcttgagggctggagaggtgagcggaa

SEQ ID NO: 2429 - DNA, 1548 bp, Candidatus Cyclonatronum proteinivorum
  ref <308>: DATABASE ACCESSION NUMBER: NCBI ACCESSION: NZ_CP027806.1
  ref <309>: DATABASE ENTRY DATE: 2019-04-01
  ref <313>: RELEVANT RESIDUES IN SEQ ID NO: (1)..(1548)
caatttacaacggagagtttgatcctggctcaggacgaacgctggcggcgggcttaacacatgcaagtcgcaggggattcagggggcttgccccctgatgagactggcgcacgggtgcgtaacacgtaagcaatctgcctacaggagggggataacccggcgaaagccgggctaataccgcataatgcagcggggccgcatggccacagttgttaaagcccttcggggtgcctgtagatgagcttgcggtgcattaggtagttggtgaggtaacggctcaccaagcctgtgatgcataggggttctgagaggatggtcccccacactggaactgagacacggtccagactcctacgggaggcagcagtgaggaatattgcgcaatgggcgaaagcctgacgcagccacgccgcgtgccggaagaaggtcctttggattgtaaacggcttttaccagggaagaaccggctggtttcgaccggccctgacggtacctggtgaataagcaccggctaactccgtgccagcagccgcggtaatacggagggtgcaagcgttgtccggaatcattgggtgtaaagggtgcgcaggcgggcttttaagtctggggtgaaatcttgccgcttaacggtaaaatggccctggatactggaagtcttgagtgtgacagaggttggcggaattcgtagtgtagcggtgaaatgcacagatattacgaagaacaccagtggcgtaggcggccaaccgggtcacaactgacgctcaggcacgagagcgtgggtagcgaacaggattagataccctggtagtccacgccgtaaacgatgtatactaggtgttggtccttttaggatcagtgctgcagctaacgcattaagtataccacctggggagtacgtcggcaacgatgaaactcaaaggaattgacgggggcccgcacaagcggtggagcatgtggcttaattcgatgcaacgcgaagaaccttacctgggctaaatttgtggttagggatccgaaaggtgaccgaccggcttgccggcgccacagaaggtgctgcatggctgtcgtcagctcgtgccgtgaggtgttgggttaagtcccgcaacgagcgcaacccctatggttagttaccagcacgtaaaggtggggactctggccagactgcctacgcaagtagtgaggaaggtggggacgacgtcaagtcatcatggcccttacgtccagggctgcacacgtgctacaatggttggtacagagggtagcgaccccgcgaggggcagccaatccttaaagccaatcccagttcggattggagtctgcaacccgactccatgaagttggaatcgctagtaatcgcgtatcagcaacgacgcggtgaatacgttcccgggccttgtacacaccgcccgtcaagcgatggaagtggggagtacctgacgccgccgcgctaacccttcggggaggccggtgtccagggtaagcctcataactggcgctaagtcgtaacaaggtagccgtaccggaaggtgcggctggatcacctccttt

SEQ ID NO: 2430 - DNA, 1571 bp, Candidatus Desulfofervidus auxilii
  ref <308>: DATABASE ACCESSION NUMBER: NCBI ACCESSION: NZ_CP013015.1
  ref <309>: DATABASE ENTRY DATE: 2019-04-01
  ref <313>: RELEVANT RESIDUES IN SEQ ID NO: (1)..(1571)
tttatcggagagtttgatcctggctcagagtgaacgctaggggcgtacctaacacatgcaagtcgtgcgagaaacctacccttcggggtagggagtaaagcggcggacgggtgagtaatgcgtaggtaacctgcctccgagaggggaataacctaccgaaaggtgggctaatgccccataagctcacggccactacggtggttgtgagaaaagatggcctctgcatgcaagctgtcgctcggagaggggcttacgtcctatcagctagttggtgaggtaatggctcaccaaggctacgacgggtagccggcctgagagggtggtcggccacactggcactgagacacgggccagactcctacgggaggcagcagtggggaatattgggcaatgggcgcaagcctgacccagtaacgccccgtgggtgatgaaggccttcgggtcgtaaagccctgtcaggtgggaagaatatctgatgggtaaatagcccattggattgacggtaccaccagaggaagcaccggctaactccgtgccagcagccgcggtaatacggagggtgcgagcgttactcggaattactgggcgtaaagggcgcgtaggcgggaaggcaagttgagcgtgtaagcctgaggctcaacctcagaatggcgctcaaaactgcctttcttgagtcccggagaggccggcggaattcccggtgtaggggtgaaatccgtagatatcgggaggaacaccggtggcgaaggcggccggctggacgggtactgacgctgaggcgcgaaagcgtggggagcaaacaggattagataccctggtagtccacgccgtaaacgatgagcactaggtgtgggggaggttatctcttccgtgccgaagctaacgcattaagtgctccgcctggggagtacggccgcaaggttaaaactcaaaggaattgacgggggcccgcacaagcggtggagcatgtggtttaattcgatgctacgcgaagaatcttacctgggcttgacatccccggaaccctgccgaaaggcgggggtgccccttcgggggaaccgggtgacaggtgctgcatggctgtcgtcagctcgtgtcgtgagatgttgggttaagtcccgcaacgagcgcaacccctgcccttagttgccagcggttcggccgggcactctaaggggactgccggcgataagccggaggaaggtggggatgacgtcaagtcatcatggcccttatgcccagggctacacacgtgctacaatggctggtacaaagggtcgcgaaaccgcgaggtggagctaatcccaaaaagccagccccagttcggatcgaaggctgtaactcgccttcgtgaaggcggaatcgctagtaatggcggatcagaatgccgccgtgaatacgttcccgggccttgtacacaccgcccgtcacaccacgaaagtcggctgtaccagaagtcgctggcccaaccccgcaaggggagggaggcgcccaaggtgtggtcggcgattggggtgaagtcgtaacaaggtagccgtaggggaacctgcggctggatcacctcctttcaa

SEQ ID NO: 2431 - DNA, 1702 bp, Candidatus Desulforudis audaxviator
  ref <308>: DATABASE ACCESSION NUMBER: NCBI ACCESSION: NC_010424.1
  ref <309>: DATABASE ENTRY DATE: 2019-04-01
  ref <313>: RELEVANT RESIDUES IN SEQ ID NO: (1)..(1702)
tttatggagagtttgatcctggctcaggacgaacgctggcggcgtgcctaacacatgcaagtcgtgcgattgagaggtgagcatctcacttctcaagagcggcggacgggtgagtaatgcgtgaacaatctaccggcaagactgggacaacaccgggaaactggtgctaataccggataatctccaccggcggcatcgttggtggaggaaagtcggcctctggatatgctggcgcttgtcgatgagttcacgtcccattagcttgttggtggggtaacggcccaccaaggcgacgatgggtagccggcctgagagggtggtcggccacactgggactgagacacggcccagactcctacgggaggcagcagtggggaatcttccgcaatgggcgcaagcctgacggagcgacgccgcgtgagggacgaaggccttcgggttgtaaacctcttttctgggggaagaacgtccggcctgttaatagcgggttgggttgacggtacctcaggaataagccccggctaactacgtgccagcagccgcggtaatacgtagggggcgagcgttgtccggaatcactgggcgtaaagggcgcgtaggcggcttgagaagtcgcaggtgaaatcccgcggctcaaccgtggaactgcctgcgaaaccattgggcttgaggacaggagagggaagcggaattcctggtgtagcggtgaaatgcgtagatatcaggaggaacaccagtggcgaaggcggctttctggcctggtcctgacgctgaggcgcgaaagctaggggagcaaacaggattagataccctggtagtcctagctgtaaacgatgggcactaggtgttggggggttcatacccttcagtgccgtaggtaacccaataagtgccccgcctggggagtacggtcgcaagactgaaactcaaaggaattgacgggggcccgcacaagcggtggagcatgtggtttaattcgatgcaacgcgaagaaccttaccagggtttgacatgtcggtggtacggagtggaaacacgaaggacccttcggggagccggtacaggtggtgcatggttgtcgtcagctcgtgccgtgaggtgttgggttaagtcccgcaacgagcgcaacccttacttctagttgccagcgggttaagccgggcactctagagggactgccgtcgacaaggcggaggaaggtggggatgacgtcaaatcatcatgccctttataccctgggctacacacgtgctacaatggccggtacagcgggaagctaaggcgtgagctggagcaaatcccaaaaagccggtccaagttcggattgcaggctgcaactcgcctgcatgaagtcggaatcgctagtaatcgcaggtcagcatactgcggtgaatgcgttcccgggccttgtacacaccgcccgtcacaccacgaaagtcggcaacacccgaagtcggtgacccaacccgttcggaggttggaggtcagaagttggaggttggactgggaaggacattggggtcgagaggagtttttgaagagggattctgaaagatcctaaaggaatgcccggatctgacatccgatatccggcttccgacttccgaatgggagggagccgcctaaggtggggtcggtgattggggtgaagtcgtaacaaggtagccgtacgggaacgtgcggctggatcacctcctttcta

SEQ ID NO: 2432 - DNA, 1571 bp, Candidatus Desulfosporosinus infrequens
  ref <308>: DATABASE ACCESSION NUMBER: NCBI ACCESSION: NZ_OMOF01000068.1
  ref <309>: DATABASE ENTRY DATE: 2019-04-01
  ref <313>: RELEVANT RESIDUES IN SEQ ID NO: (1)..(1571)
tttatggagagtttgatcctggctcaggacgaacgctggcggcgtgcctaacacatgcaagtcgaacggagaatttcgaagagtttacttggagaaatttttagtggcggacgggtgagtaacgcgtgggtaacctacccataaacccgggacaacccttggaaacgagggctaataccggataatctttggacttggcatcaagttttaagaaaaggtggcctctgtatatgctaccgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaatgattggtttgaaaatattgagccaatatgacggtacccaaggaggaagccccggctaactacgtgccagcagccgcggtaatacgtagggggcaagcgttgtccggaattattgggcgtaaagggcgcgtaggcggatgtttaagtccggtgtgaaagatcagggctcaaccctgagagtgcatcggaaactgggcatcttgaggacaggagaggaaagtggaattcctagtgtagcggtgaaatgcgtagatattaggaggaacaccagtggcgaaggcgactttctggactgtaactgacgctgaggcgcgaaagcgtggggagcaaacaggattagataccctggtagtccacgctgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccagggcttgacatctacagaatccttaggaaactagggagtgcccttcggggagctgtaagacaggtggtgcatggttgtcgtcagctcgtgtcgtgagatgttgggttaagtcccgcaacgagcgcaacccctgtgtttagttgctaacgagtaaggtcgagcactctagacagactgccggtgataaaccggaggaaggtggggatgacgtcaaatcatcatgccccttatgttctgggctacacacgtgctacaatggccggtacagacggacgcgaagccgcgaggtgaagcaaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgtaagggagctagccgtcgaaggtggggccgataattggggtgaagtcgtaacaaggtagccgtatcggaaggtgcggctggatcacctcctttcta

SEQ ID NO: 2433 - DNA, 1554 bp, Candidatus Desulfovibrio trichonymphae
  ref <308>: DATABASE ACCESSION NUMBER: NCBI ACCESSION: NZ_AP017368.1
  ref <309>: DATABASE ENTRY DATE: 2019-04-01
  ref <313>: RELEVANT RESIDUES IN SEQ ID NO: (1)..(1554)
ttgaactggagagtttgattctggctcagattgaacgctggcggcgtgcttaacacatgcaagtcgaacgcgaaaggggcttcggttctgagtagagtggcgcacgggtgagtaacgcgtggatgatctgcccttatgatggggataacagttggaaacggctgctaataccggatacgctcgggagtaaaattttgaggaaagacggcctctgcgtgcaagctgtcgcataaggatgagtccgcgtcccattagcttgttggtggggtaacggcctaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggtcttcggatcgtaaacctctgtcggaggggaaaaatgcagcatatgctaatcagtgtgctgttgatggtacccttaaaggaagcaccggctaactccgtgccagcagccgcggtaatacggagggtgcgagcgttaatcggaattactgggcgtaaagcgcacgtaggctgttacgtaagtcaggggtgaaagcccacggctcaaccgtggaattgcctttgatactgcgcgacttgaatccgggagagggtggcggaattccaggtgtaggagtgaaatccgtagatatctggaggaacaccagtggcgaaggcggccacctggaccggtattgacgctgaggtgcgaaagcgtggggagcaaacaggattagataccctggtagtccacgctataaacgatggatgctggatgtcggggagtattttccggtgtcgcagctaacgcgttaagcatcccgcctggggagtacggtcgcaaggctgaaactcaaagaaattgacgggggcccgcacaagcggtggagtatgtggtttaattcgatgcaacgcgaagaaccttacctgggtttgacatccgcggaacccttctgaaagggaggggtgcccttcggggagctgcgagacaggtgctgcatggctgtcgtcagctcgtgtcgtgagatgttgggttaagtcccgcaacgagcgcaacccctatgcacagttgccagcaagtgaagttgggcactctgtgcagactgcccgggttaaccgggaggaaggtggggacgacgtcaagtcatcatggcccttacacccagggctacacacgtactacaatggcgcgtacaaaggggagcgagaccgcaaggtggagccaatcccaaaaaacgcgtctcagtccggattgcagtctgcaactcgactgcatgaagtcggaatcgctagtaattcgagatcagcatgctcgggtgaatgcgttcccgggccttgtacacaccgcccgtcacaccacgaaagttggttttacccgaagccggcgagccaaccagcaatggaggcagccgtctacggtagggccggtgattggggtgaagtcgtaacaaggtagccgtaggggaacctgcggctggatcacctcctttaa

SEQ ID NO: 2434 - DNA, 1497 bp, Candidatus Endolissoclinum faulkneri
  ref <308>: DATABASE ACCESSION NUMBER: NCBI ACCESSION: NZ_CP006745.1
  ref <309>: DATABASE ENTRY DATE: 2019-04-01
  ref <313>: RELEVANT RESIDUES IN SEQ ID NO: (1)..(1497)
tcaacctgagagtttgatcctggctcagaacgaacgctggcggcatgcctaacacatgcaagtcgaacggctctttacagagtagtggcgcacgggtgagtaacgcgtgggaacctgccttaaggtatggaataacggctggaaacggccgctaataccatataatccctaaggggtaaagattttatcgccttaagaggggcccgcgtccgattagcttgttggtgaggtaatggctcaccaaggctttgatcggtagctggtctgagaggatgatcagccacactgggactgagacacggcccagattcctacgggaagcagcagtgaggaatattggacaatgggcgaaagcctgatccagcaatgccgcgtgtgtgatgaaggccttagggttgtaaagcactttcgccgatgacgatgatgacggtagtcggataagaagtcccggctaactccgtgccagcagtcgcggtaatacggagggggcaagcgttgttcggaattactgggcgtaaagggcgcgtaggcggttatgtaagttggaagtgaaagccctgggctcaacctaggaactgctttcaatactgcgtagctcgagagcgggagagggtggtggaatttccagtgtagaggtgaaattcgtagatattggaaagaacgccagtggcgaaggcggctgcctggcccgtttgtctgacgctaaggcgcgaaagcgtggggagcaaacaggattagataccctggtagtccacgccgtaaacgatgagtgctagacgttggaggctatgtccttcagtgtcgtcgctaacgcattaagcactccgcctggggagtacggccgcaaggttaaaactcaaaggaattgacgggggcccgcacaagcggtggagcatgtggtttaattcgaagcaacgcgcagaaccttaccagctcttgacatggagggtgtggttattggagacaataaccttcagttcggctggccctcacacaggtgctgcatggctgtcgtcagctcgtgtcgtgagatgttgggttaagtcccgcaacgagcgcaacccttactgccagttgccagcggttaggccgggcactctggcggaactgcctgtgaaaagcaggaggaaggtggggatgacgtcaagtcctcatggcccttatgagctgggctacacacgtcctacaatggcggtgacaatgggcagcaaaagggtgacctagagctaatcctcaaaagccgtctcagttcggattgcactctgcaactcgagtgcatgaaggtggaatcgctagtaatcgtggatcagaatgccacggtgaatacgttcccgggccttgtacacaccgcccgtcacaccatgggagttggttttacccgaaaacggtgagctaaccgaaaggaggcagccgatcacggtaaggtcagcgactggggtgaagtcgtaacaaggtagccgtaggggaacctgcggctggatcacctcctttctaaaa

SEQ ID NO: 2435 - DNA, 1518 bp, Candidatus Endomicrobium trichonymphae
  ref <308>: DATABASE ACCESSION NUMBER: NCBI ACCESSION: NZ_AP017459.1
  ref <309>: DATABASE ENTRY DATE: 2019-04-01
  ref <313>: RELEVANT RESIDUES IN SEQ ID NO: (1)..(1518)
tggagagtttgatcctggctcagagtgaacgctagcggcgtgcctaacacatgcaagttgtgcgggattctgcagagtatcgcagagtttagcggcaaacgggtgagtaacacgtaggaaacctccctcagaatggggaatatttccgagaaatcggagccaataccgcataagaccacagtttggcatcaaatagtggttaaagcagcaatgcgttttgagatggtcctgcgtcctatcagctagttggcagggtaacggcccgccaaggctatgacgggtatccgtccttaaagggtgaacggacacactggaactgagacacggtccagactcctatgggaggcagcagtggggaattttggacaatgggggaaaccctgatccagcgacgccgcgtggaggatgaaggccttcgggttgtaaactccttttagaggggaagaaataaatgacattaccctcagaaaaagccacggctaactacgtgccagcagccgcggtaatacgtaggtggcgagcgttactcggaattactaggcgtaaagcgtatgtaggctgtcgtataagtctttagtaaaatttcccggctcaaccgagaaaagcctaatggatactgttcgacttgagtgtgggagagggagacggaattcctggtgtagcggtgaaatgcgtagatatcaggaggaacaccgatggcgaaagcagtctcctggaccaatactgacgctgatgtacgaaagctagggtagcaaacaggattagataccctggtagtcctagctgtaaactatgttcactagatgtgggaggtatcgaccccttccgcgtcgacgttaacgcattaagtgaaccgcctggggagtacggccgcaaggttgaaactcaaaggaattgacgggggcccgcacaagcggtggagtatgtggtttaattcgacgcaacgcgaagaaccttacctgggcttgaactgctgatggtaaaaaccggaaacggtgatgacccgcaagggagtcagcagaggtgttgcatggctgtcgtcagctcgtgtcgtgagatgttgggttaagtcccgcaacgagcgcaacccttatcccatgttacctgtagcgatacggggtctctgaggaaactgccattgataaaatggaggaaggtgaggacgacgtcaagtcatcatgtcctttatgtccagggctacacacgtactacaatggccggtacagagggcagcaatatcgtaaggtggagcaaatccctgaaagccggccccagttcagattgtgggctgcaattcgtccacatgaagtaggaatcgctagtaatcgcagatcagcaggctgcggtgaatacgttcccgggccttgtacacaccgcccgtcacaccacgaaagtcagtcataacagaagtcgtcgggctaaccgaaaggaggcagtcgcctaagttatggttggtgattggggtgaagtcgtaacaaggtagccgtacgagaacgtgcggctggatcacctcctttt

SEQ ID NO: 2436 - DNA, 1497 bp, Candidatus Filomicrobium marinum
  ref <308>: DATABASE ACCESSION NUMBER: NCBI ACCESSION: NZ_LN829118.1
  ref <309>: DATABASE ENTRY DATE: 2019-04-01
  ref <313>: RELEVANT RESIDUES IN SEQ ID NO: (1)..(1497)
aactcttcaacatgagagtttgatcctggctcagaacgaacgctggcggcaggcctaacacatgcaagtcgaacgccccgcaaggggagtggcagacgggtgagtaacgcgtgggaacctacctattggtgcggaataactcggggaaacccgtgctaataccgcataagcccgagaggggaaagatttatcgccgatagatgggcccgcgtcggattagcttgttggtgaggtaatggctcaccaaggcgacgatccgtagctggtctgagaggatgatcagccacactgggactgagacacggcccagactcctacgggaggcagcagtggggaatattggacaatgggggaaaccctgatccagccatgccgcgtgagtgacgaaggccttagggttgtaaagctcttttggcggggacgataatgacggtacccgcagaataagccccggctaacttcgtgccagcagccgcggtaatacgaagggggctagcgttgttcggaatcactgggcgtaaagcgcacgtaggcggacttgttagtcaggggtgaaatcccggggctcaaccccggaactgcctctgaaactgcaagtcttgagtccgagagaggtgagtggaattcctagtgtagaggtgaaattcgtagatattaggaagaacaccagtggcgaaggcggctcactggctcggtactgacgctgaggtgcgaaagcgtggggagcaaacaggattagataccctggtagtccacgccgtaaacgatggatgctagccgtcggcaagcttgcttgtcggtggcgcagctaacgcattaagcatcccgcctggggagtacggccgcaaggttaaaactcaaaggaattgacgggggcccgcacaagcggtggagcatgtggtttaattcgatgcaacgcgaagaaccttaccagctcttgacatttcctgactgtttccagagatggattcgtcccagcaatgggcaggaggacaggtgctgcatggctgtcgtcagctcgtgtcgtgagatgttgggttaagtcccgcaacgagcgcaaccctcaccattagttgccatcattaagttgggcactctagtgggactgccggtgataagccggaggaaggtggggatgacgtcaagtcatcatggcccttatgggctgggctacacacgtgctacaatggcagtgacaatgggcagccactcagcaatgaggcgctaatcccaaaaaactgtctcagttcggattggactctgcaactcgagtccatgaagtcggaatcgctagtaatcgcggatcagcatgccgcggtgaatacgttcccgggccttgtacacaccgcccgtcacaccatgggagttggttttacccgaaggcgctgcgctaacccgcaagggaggcaggcgaccacggtaaggtcagcgactggggtgaagtcgtaacaaggtagccgtaggggaacctgcggctggatcacctcctttctaagg

SEQ ID NO: 2437 - DNA, 1507 bp, Candidatus Finniella inopinata
  ref <308>: DATABASE ACCESSION NUMBER: NCBI ACCESSION: NZ_SCFB01000004.1
  ref <309>: DATABASE ENTRY DATE: 2019-04-01
  ref <313>: RELEVANT RESIDUES IN SEQ ID NO: (1)..(1507)
aacatgagagtttgatcctggctcagaacgaacgctggcggcatgcttaacacatgcaagtcgaacggggtacgagtgcttgcacttgtacttaggtggcagacgggtgagtaacgcgtgggaacgtaccttttggttcaggacaacggctggaaacggtcgctaatactggataagcccttagggggaaagatttattgccaagagagcggcccgcgttagattaggtagttggtagggtaatggcctaccaagcctatgatctatagctggtttgagaggatgatcagccacactgggactgagacacggcccagactcctacgggaggcagcagtggggaatattggacaatgggggcaaccctgatccagcgatgccgcgtgagtgatgaaggccttcgggttgtaaagctcttttgtgggggacgatgatgacggtaccccacgaataagtcccggctaacttcgtgccagcagccgcggtaatacgaagggggctagcgttgttcggaatgactgggcgtaaagggtgcgtaggcggtttgataagtttggtgtgaaagtcctgggctcaacctggggattgcattggaaactgttagactagagatcgagagaggaaaatggaattgcgagtgtagaggtgaaattcgtagatattcgcaagaacaccggtggcgaaggcggttttctggctcgatactgacgctaaggcacgaaagcgtggggagcaaacaggattagataccctggtagtccacgctgtaaacgatgaatgctagatgttgggggggcaacccttcagtgtcgtagttaacgcgataagcattccgcctggggagtacggtcgcaagattaaaacttaaaggaattgacggggacccgcacaagcggtggagtatgtggtttaattcgaagcaacgcgcagaaccttaccagcttttgacatggaacgtttgaggaccagagatggttttcttcagttaggctggcgttcacacaggtgctgcatggctgtcgtcagctcgtgtcgtgagatgttgggttaagtcccgcaacgagcgcaacccttgccgttagttgccatcaggttgggctgggcactttaacggaactgccggtgataagccggaggaaggtagggatgacgtcaagtcctcatggcccttataggctgggctacacacgtactacaatggcggtgacagaagggagcgaaggagtgatctggagcgaatccttaaaagccgtctcagttcggattgttctctgcaactcgagagcatgaagtcggaatcgctagtaatcgtagatcagcatgctacggtgaatacgttcccgggtcttgtacacactgcccgtcacaccatgggagttggttttaccttaaggcggtgagctaacctgcaaaggaggcagccgaccacggtaggatcagtgactggggtgaagtcgtaacaaggtagccgtaggggaacctgcggctggatcacctcctttctaag

SEQ ID NO: 2438 - DNA, 1523 bp, Candidatus Fokinia solitaria
  ref <308>: DATABASE ACCESSION NUMBER: NCBI ACCESSION: NZ_CP025989.1
  ref <309>: DATABASE ENTRY DATE: 2019-04-01
  ref <313>: RELEVANT RESIDUES IN SEQ ID NO: (1)..(1523)
aaacgtgagagtttgatcctggctcagagtgaacgctagcggcgggcttaacacatgcaagtcgagcggagaggctaaaaaatgctttgtagtgcttgcactacgaagtatttcttagaattttagcggcagacgggtgagtaatacatgggaatctaccttgtagcgtgggataacagagggaaacttctgctaataccgcatacaaccgagaggtaaaaggcagcaatgtcactacaagatgagcccttgcaagattagctagttggtaaggtaatggcttaccaaggctacgatctttagttggtctgagaggatgatcagccacactggaactgagacacggtccagactcctacgggaggcagcagtggggaatattggacaatgggcgaaagcctgatccagcaacgccgcgtgagtgatgaaggccttagggttgtaaagctcttttggtagggatgataatgacagtacctacagaaaaagccccggctaacttcgtgccagcagccgcggtaatacgaagggggctagcgttactcggaattactgggcataaagcgtgtgcaggctgatcaaaaagtcgaaagtgaaatccttgagcttaactcaagaactgcttccgatactgttgatcttgaataacagaggggacaacggaattcctagtgtaggggtgaaatccgtagatattaggaggaacaccgatggcgaaagcggttgtctggctgattattgacgctgttacacgaaagcgtggggagcaaacaggattagataccctggtagtccacgcagtaaacgatgagtgctgggtgtcggattttatattcggtgccgaagctaatgcgttaagcactccgcctggggagtacggtcgcaagactaaaacttaaaggaattgacggggacccgcacaagcggtggaacatgtggtttaattcgatgctacgcgaaagaccttaccaagtcttgatggtgatcataagctatccaagaaactggatagtgcatttagttggatcatcacaggtgttgcatggctgtcgtcagctcgtgtcgtgagatgttgggttaagtcccgcaacgagcgcaacccttatccttagttgccaacagtttggctgggaactctaaggagactgctgatgataaatcagaggaaggtggggatgatgtcaagtcagcatggcccttatgacttgggcaacacacgtgttacaatggcgattacagaaggctgcaacagggtgacctagagctaatccttaaaaatcgcctcagttcggattgtatcctgcaactcggatacatgaagttggaatcgctagtaatcgcggatcagcatgccgcggtgaatacgttctcgggtcttgtacacactgcccgtcacgccatgggagtcgattttgccttaagtatgtgagctaaccgcaaggacgcagcataccaaggtagggttggtgactgaggtaaagtcgtaacaaggtagccgtaggagaacctgcggctggattact

SEQ ID NO: 2439 - DNA, 1496 bp, Candidatus Fonsibacter ubiquis
  ref <308>: DATABASE ACCESSION NUMBER: NCBI ACCESSION: NZ_CP024034.1
  ref <309>: DATABASE ENTRY DATE: 2019-04-01
  ref <313>: RELEVANT RESIDUES IN SEQ ID NO: (1)..(1496)
attaaacttgagagtttgatcatggctcagaacgtacgctggcggcacgcctaacacatgcaagtcgaacgcagtagcaatactgagtggcagacgggtgagtaacatgtgggaatctgccttgtggttcaggacaacattgggaaaccgatgctaatactggataagcccttacggggaaagttttaatgccataagatgagcccgcatttgattagttagttggtgaggtaatggctcaccaagacaatgatcaatagctgatctgagaggatgatcagccacactgggactgagacacggcccagactcctacgggaggcagcagtggggaatcttgcacaatggaggaaactctgatgcagcgatgccgcgtgagtgaagaaggcctttgggttgtaaagctcttttgtaggggaagataatgactgtaccctaagaataaggtccggctaacttcgtgccagcagccgcggtaatacgaagggacctagcgtagttcggaattactgggcgtaaagcgcgcgtaggccgttgagttagttaattgtgaaatcccaaagcttaactttggaactgcaattaaaactgctcgactagagtttgatagaggaaagcggaatacatagtgtagaggtgaaattcgtagatattatgtagaacaccagttgcgaaggcggctttctggatcaacactgacgctgaggcgcgaaagtatgggtagcaaagaggattagataccctcgtagtccataccataaacgatgattgctagatgttggaaatttattttcagtatcgcagctaacgcattaagcaatccgcctggggagtacgaccgcaaggttaaaactcaaatgaattgacggggacccgcacaagcggtggagcatgtggtttaattcgaagatacgcgcagaaccttaccaacccttgacatgtctgtcgcgagtttaggaaactagacttttcggttcggccggacagaacacaggtgctgcatggctgtcgtcagctcgtgtcgtgagatgttgggttaagtcccgcaacgagcgcaacccctacttttagttgccatcaggtcatgctgggtactctgaaagaactgccagtgataagctggaggaaggtggggatgacgtcaagtcctcatggcccttacgggttgggctacacacgtgctacaatggtagtgacaatgagatgcaaggtggcgacgctaagctaaactcaaaaatctacctcagttcggattgcactctgcaactcgagtgcatgaagctggaatcgctagtaatcgtagatcagcgtgctacggtgaatacgttcccgggtcttgtacacaccgcccgtcacaccatggaagttggttctaccttaaagcagattgctaaccgcaaggaggcgtttgaccaaggtatagtcagcgactggggtgaagtcgtaacaaggtagccgtaggggaacctgcggctggattacctcctttctaagga

SEQ ID NO: 2440 - DNA, 1547 bp, Candidatus Fukatsuia symbiotica
  ref <308>: DATABASE ACCESSION NUMBER: NCBI ACCESSION: NZ_FQSP02000076.1
  ref <309>: DATABASE ENTRY DATE: 2019-04-01
  ref <313>: RELEVANT RESIDUES IN SEQ ID NO: (1)..(1547)
aaattgaagagtttgatcatggctcagattgaacgctggcggcaggcctaacacatgcaagtcgagcggcatcgggaaggtagcttgctatctttgccggcgagcggcggacgggtgagtaaagtctggggatctgcctgatggagggggataactactggaaacggtagctaataccgcatgatgttacgcgaccaaagcgggggacctccgggcctcgcgccatcagatgaacccagatgggattagctagtaggagaggtaatggctcccctaggcgacgatccctagctggtctgagaggataaccagccacactggaactgagagacggtccagactcctacgggaggcagcagtggggaatattgcacaatgggcgcaagcctgatgcagccatgccgcgtgtgtgaagaaggccttcgggttgtaaagcactttcagcgaggaggaatgaagcaatgcaaagagtgttgctaatggacgttactcgcagaagaagcaccggctaactccgtgccagcagccgcggtaatacggagggtgcgagcgttaatcggaattactgggcgtaaagggcacgtaggcggtttcttaagtcagatgtgaaatccccgagcttcacttgggaacggcatttgaaactgagagtctagagttttgtagaggggggtagaattccaggtgtagcggtgaaatgcgtagatatctggaggaataccggtggcgaaggcggccccctggacagagactgacgctgaggtgcgaaagcgtgggtagcaaacaggattagataccctggtagtccacgctgtaaacgatgtcgatttgtaggttgtggttataaactgtggcttgcggagcaaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagaggagtcgacagagatgttgacgtgcccttcggggagctttgagacaggtgctgcatggctgtcgtcagctcgtgttgtgaaatgttgggttaagtcccgcaacgagcgcaacccttatcttttgttgccagcacgtagaggtgggaactcaagagagactgccggtgataaaccggaggaaggtggggatgacgtcaagtcatcatggcccttacgagtagggctacacacgtgctacaatggcgtatacaaagagaagcgagcctgcgagggtgagcggacctcataaagtacgtcgtagtccggattggagtctgcaactcgactccatgaagtcggaatcgctagtaatcgtggatcagaatgctacggtgaatacgttcccgggccttgtacacaccgcccgtcacaccatgggagtgttttgcaaaagaagtaggtagcttaacctttgggatggcgcttaccactttgtgaaccatgactggggtgaagtcgtaacaaggtaaccgtaggggaacctgcggttggatcacctcctta

SEQ ID NO: 2441 - DNA, 1082 bp, Candidatus Gastranaerophilales bacterium
  ref <308>: DATABASE ACCESSION NUMBER: NCBI ACCESSION: NZ_UNSK01000063.1
  ref <309>: DATABASE ENTRY DATE: 2019-04-01
  ref <313>: RELEVANT RESIDUES IN SEQ ID NO: (1)..(1082)
aatggagagtttgatcctggctcaggacgaacgctggcggcgtgcttcatacatgcaagtcgaacgcgaatcggtagcttgctaccgaggaaagtggcggacgggtgagtaatgtgtagagaatctgccctagagcgggggacaacagctggaaacggttgctaataccccatatgagcgtatctgaaatggtattcttgaaaactccggtgctctaggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgattgataaagcccttcggggtgtaaagatctgtcagtggggacgaaacttgacggtacccacagaggaagcaccggctaactccgtgccagcagccgcggtaatacggagggtgcaagcgttgtccggaatcattgggcgtaaagagttcgtaggtggtttgttaagtttggtgttaaatgcagaggctcaacttctgttcggcatcggatactggcagactagaatgcggtagaggtaaagggaattcctggtgtagcggtgaaatgcgtagatatcaggaggaacatcggtggcgtaagcgctttactgggccgtaattgacactgaggaacgaaagccagggtagcaaatgggattagataccccagtagtcctggccgtaaacgatggatactaggtgttgcgggtatcgacccctgcagtgccgtagctaacgcgttaagtatcccgcctggggagtacgcacgcaagtgtgaaactcaaaggaattgacggggacccgcacaagcggtggaacatgtggtttaattcgaagcaacgcgaagaaccttaccagggcttgacatctaacaaacctttgtgaaagcagagggtgctcttcggagaatgttaagacaggtggtgcacggttgtcgtcagctcgtgtcgtgagatgttgggttaagtcccgcaacgagcgcaa

SEQ ID NO: 2442 - DNA, 1480 bp, Candidatus Gracilibacteria bacterium HOT-871
  ref <308>: DATABASE ACCESSION NUMBER: NCBI ACCESSION: NZ_CP017714.1
  ref <309>: DATABASE ENTRY DATE: 2019-04-01
  ref <313>: RELEVANT RESIDUES IN SEQ ID NO: (1)..(1480)
agagtttgatcctagctcagggtgaacgctagcggtgcgcctaacacatgcaagtcgagcggaattgatatgttgaaagcttcggtgggaaatatattgagagagcggcgaacgggtgaggaacacgttggaatctgcccccaagtcagggatagcccagggaaacctggattaataccggatagtctctttggagtaaagatttattgcttggggaggagcctgcgtactatcagctagttggtagggtaaaagcctaccaaggcaatgacggataactggtctgagaggatgatcagtcacaatggaactgagacacggtccatactcctacgggaggcagcagtgaggaatcttccacaatgggcgaaagcctgatggagcgacaccgcgtgaaggaagaaggcctaacggttgtaaacttcttttctgaaggagcataatgagagtactttaggaataagggacggctaaatacgtgccagcagccgcggtaatacgtatgtctcgagcgttacccggaattactgggtgtaaagggtttgtaggttggtgaataagtcaggtatgaaagaccggagcttaactccgagtttgtgcttgaaactgttgacctagaatcagggagaggtaagcggaattctaagtgtaggggtgcaatccgtagatacttagaggaacaccaaaagcgaaggcagcttactggaactgcattgacactgaaaaacgaaagcgtgggtagcgaaaaggattagatacccttgtagtccacgccctaaacgatgataactaagtgttgcgacgagctcgcagtgctgtagcaaacgcgttaagttatccacctgaggagtacggtcgcaagattaaaactcaaaggaatagacggggacccacacaagcagtggatcacgtggtttaattcgacaataaacggggaaccttacccagacttgacatcctaggaatactttagagatagagtagtgctcgcaagagaacctagagacaggtgctgcatggttgtcgtcagctcgtgccttgaggtgttcggttaagtccgttaacgagcgcaacccatgtccttagttacaatgtctaaggagactgccttggttaacaaggaggaaggtgtggatgacgtcaaatcagcatggcttttacgtctggggctacacacatgatacaatggcctgtacaaagagtagtgaaaccgcgaggtagaaccaatcttgaaagcaggtctcagtccggattggagtctgcaactcgactccatgaagttggaattgctagtaatcgtaaatcagatatgttacggtgaatgtgttcctgggtcttgtactcaccgcccgtcaaggcatgggaggtagtaatatcggaagtccccctagatataagggggcccatggtaggactactgactgggcttaagtcgtaacaaggtatccgtaggtgaacctgcggatggactatctcctta

SEQ ID NO: 2443 - DNA, 1031 bp, Candidatus Hepatobacter penaei
  ref <308>: DATABASE ACCESSION NUMBER: NCBI ACCESSION: NZ_JQAJ01000002.1
  ref <309>: DATABASE ENTRY DATE: 2019-04-01
  ref <313>: RELEVANT RESIDUES IN SEQ ID NO: (1)..(1031)
gagagtttgatcctggctcagaatgaacgctggcggcatgcctaacacatgcaagtcgaacgcaataggttcgcctattgagtggcagacgggtgagtaatacacgggaatctacctctaggtaaggaatagctacgggaaactgtaggtaataccttataatatgtgcaaacatcaaagatttatcgcctagagaggagcccgtgccagattaggtcgttggtggggtaacagcctaccaagcctatgatctgtagttggtctgagaggatgatcagccacactgggactgagaacggcccagactcctacggggggcagcagtggggaatattggacaatgggcgaaagcctgatccagccatgccgcgtgtgtgaagaaggtcttcggattgtaaagcactttaagttgggaggaagggcagtaagttaataccttgctgttttgacgttaccaacagaataagcaccggctaacttcgtgccagcagccgcggtaatacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcgactagccgttgggatccttgagatcttagtggcgcagctaacgcgataagtcgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcg

SEQ ID NO: 2444 - DNA, 1541 bp, Candidatus Hepatoplasma crinochetorum
  ref <308>: DATABASE ACCESSION NUMBER: NCBI ACCESSION: NZ_CP006932.1
  ref <309>: DATABASE ENTRY DATE: 2019-04-01
  ref <313>: RELEVANT RESIDUES IN SEQ ID NO: (1)..(1541)
aatttttgagagtttgatcctggctcaggattaacgctggcggcatgcctaatacatgcaagtcgaacgaaatttcttttattagaaatttagtggcgaacgggtgagtaatgtatgtttaatctgcctcaaagaggagaataactattggaaacgatagctaatactccatagcgtaatataaggcatcttatattgcctaaaggtgcgtttgcatcgctttgagatgagaacatatcacattagctagttggtagggtaaaagcctaccaaggcaacgatgtgtagccggactgagaggttgaacggccacaatgggactgagacacggcccatactcctacgggaggcagcagtagggaatttttcacaatggacgaaagtctgatgaagcaatgccgcgtgaaggaagacagttttcggattgtaaacttctgttatgagggaagaatagttaagataggaaatgattttaatttgacggtaccttgttagaaagtcacggcaaactatgtgccagcagccgcggtaatacataggtggcgagcgttatccggatttattgggcgtaaagagtgcacaggtggtttattaagtcagttgttaaagatcgaagcttaacttcgattcgcatctgaaactagtaagctagaatacaggtgggggcaatggaattccatgtgtagcggtggaatgcataaatatgtggaggaacaccagtggcgaaggcggttgcctgaactgtaattgacacttaagcacgaaagcgtggggagcaaataggattagataccctagtagtccacgccgtaaacgatctagactagttgttgccattaaaggcagtaacgcagctaacgcattaagtctagcgcctgggtagtatgcacgcaagtgtgaaactcaaaggaattgacggggacccgcacaagtggtggagcatgtggtttaattcgatgatacgcgaagaaccttacctacgtttgacatacttggcaaatccatagagatatggaggaggttaaccaatgtacaggtggtgcatggttgtcgtcagctcgtgtcgtgagatgttcggttaagtccggtaacgagcgcaacccctttcttatgttactaacaattaaagttgaggactcatgagatactgcctgggtaaccaggaggaaggtggggatgacgtcaaatcatcatgccccttatacgtagggctacacacgtgctacaatggctattacaaagggttgccaagccgcaaggtggagctaatcccaaaaagatagtctcagttcggattgaagtctgcaatttgactttatgaagctggaatcactagtaatcgcaggtcagcaatactgcggtgaatgcgttctcgggtcttgtacacaccgcccgtcaaaccacgaaagtcggtaatacctaaaaccgttgttctaacccatttttttgggaggaaggcgtctagggtaggattgatgattggggttaagtcgtaacaaggtacccctaccggaaggtgggggtggatcacctcctttcta

SEQ ID NO: 2445 - DNA, 1589 bp, Candidatus Jettenia caeni
  ref <308>: DATABASE ACCESSION NUMBER: NCBI ACCESSION: NZ_BAFH01000004.1
  ref <309>: DATABASE ENTRY DATE: 2019-04-01
  ref <313>: RELEVANT RESIDUES IN SEQ ID NO: (1)..(1589)
tatgaagggtatgatcttggctcagaacgaacgctggcggcgtggattaggcatgcaagtcgaacgagggagtgttccgaaaggggcacaaaccgagtggcgtaagggtgagtaatgcattgataacctacctttgagacggggataacaacgttccgcaagggactcccgaaagggttgctaatacccgataaaactcatggtgcttcggtatcgggagtcaaaggtttggggctgaaaggttccatatgctcagagaggggtcaatgtcctatcagctagttggcagggtaaaggcctaccaaggcgaagacgggtagccggcctgagagggtggtcggccacattgggactgagacactgcccagactcctacgggaggctgcagtcgagaatctttcgcaatgcccggaagggtgacgaagcgacgccgcgtgtgggaagaaggccttcgggttgtaaaccactgtcgggagttaagaagtgtaagggggtgaatagccctcttacttgacgttagctccggaggaagccacggctaactctgtgccagcagccgcggtaatacagaggtggcaagcgttgttcggaattattgggcgtaaagagcacgtaggcggccctacaagtcagctgtgaaatccttctgctcaacggaagaacggcagttgatactatagggctggagtgcgggaggggagagtggaacttctggtggagcggtgaaatgcgtagatatcagaaggaacatcggcggcgaaagcgactctctggcccgtaactgacgctgaggtgcgaaagctaggggagcaaacgggattagataccccggtagtcctagccgtaaacgatgggcactcggtagaggggttttgattatctctctgcctgagctaacgcgttaagtgccccgcctggggagtacggccgcaaggctaaaactcaaaagaattgacgggggctcgcacaagcggtggagcatgtggcttaattcgatgcaacacgaagaaccttaccggggcttgacatggtagaagtaggagcccgaaagggtaacgaacggtatccagtccgtagctatcacaggtgttgcatggctgtcgtcagctcgtgtcgtgagacgttgggttaagtcccctaacgagcgaaacccttgtctttagttgccaacaggtcaagctgggcactctaaagagactgctgtcgtcaagacggaggaaggtggggatgacgtcaagtcatcatggcccttatgtcccgggctgcacacgtgctacaatggtcggtacaaagggatgccaagtcgcaagacggagcgaaacccaaataaagccgatcccagttcagattggaggctgaaacccgcctccatgaagtaggaatcgctagtaatcgcggatcagctatgccgcggtgaatatgttcccgagccttgtacacaccgcccgtcaagccacccaagcaagatgcacccgaagccactggcctaacccgcaagggacggaagtgtctaaggtgtgttttgtgaggaggactaagtcgtaacaaggtagtcgtaggagaacctgcggctggatcacctcctttct

SEQ ID NO: 2446 - DNA, 1508 bp, Candidatus Jidaibacter acanthamoeba
  ref <308>: DATABASE ACCESSION NUMBER: NCBI ACCESSION: NZ_JSWE01000036.1
  ref <309>: DATABASE ENTRY DATE: 2019-04-01
  ref <313>: RELEVANT RESIDUES IN SEQ ID NO: (1)..(1508)
aggataaaacttgagagtttgatcctggctcagagtgaacgctggcggcgtgcttaacacatgcaagtcgaacgagtaagagccgtagcaatacggagttctgctagtggcagacgggtgagtaatacatgggaatctaccttaaagtctgggataactgttggaaacgacagctaataccggatattgccgagaggtgaaagatttattgctttaagatgagcccatgcaagattagcttgttggtggggtaatggcctaccaaggctacgatctttagctggtttgagaggatgatcagccacactggaactgagacacggtccagactcctacgggaggcagcagtggggaatattggacaatgggcgaaagcctgatccagcgacgccgcgtgagtgatgaaggccttcgggttgtaaagctcttttagtagggaagataatgacggtacctacagaaaaagccccggctaacttcgtgccagcagccgcggtaatacgaagggggcaagcgttactcggaattactgggcgtaaagcgtgcgtaggcggcttggtaagttggaagtgaaagcctagggctcaaccttagaattgctttcaaaactgcctggctagagtactagagaggatagcggaattcctagtgtagaggtgaaattcgtagatattaggaggaacaccggaagcgaaagcggctatctggctagacactgacgctgttgcacgaaagcgtggggagcaaacaggattagataccctggtagtccacgcagtaaacgatgagtgctagatattggaatttaattttcagtgtcaaagctaacgcgttaagcactccgcctggggagtacggtcgcaagattaaaactcaaaggaattgacggggactcgcacaagcggtggaacatgtggtttaattcgatgctacgcgaaaaaccttaccaggccttgacatgttggtcatatcatgaagagattcatgagtcagctcggctggaccatcacaggtgttgcatggctgtcgtcagctcgtgtcgtgagatgttgggttaagtcccgcaacgagcgcaaccctcatccttagttaccaacaggttatgctgggcactctaaggaaactgccggtgataagccggaggaaggtggggatgacgtcaagtcagcatggcccttacggcctgggctacacacgtgttacaatggtggtgacaattggacgcaatagggcgacctggagcaaatccctaaaagccacctcagttcggattgtaccctgcaactcgggtacatgaagtcggaatcgctagtaatcgcagatcagcatgctgtggtgaatacgttctcgggtcttgtacacactgcccgtcaagccatgggagttggtcttaccttaagtaggtgtgctaaccgtaaggaggcagcctaccacggtgaggtcgatgactggggttaagtcgtaacaaggtagccgtaggggaacctgcggctggattacctcctttc

SEQ ID NO: 2447 - DNA, 1560 bp, Candidatus Kryptonium thompsoni
  ref <308>: DATABASE ACCESSION NUMBER: NCBI ACCESSION: NZ_CZVM01000049.1
  ref <309>: DATABASE ENTRY DATE: 2019-04-01
  ref <313>: RELEVANT RESIDUES IN SEQ ID NO: (1)..(1560)
acaacggagagtttgatggtggctcagggcgaacgctggcggcgtgcctaacacatgcaagtcagggacacggcgtgtagcaatacacgtcgtggaccggcgcacgggtgagtaacgcgtaggtaacctacccgcaggttcagaataacaccgagaaatcggtgctaatgctgaatgatgtctcggtatcgcatgataccgggattaaaggtggctcgcaagagctaccgcctgcggatgggcctgcgtcctatcaggtagttggtggggtaatggcccaccaagcctatgacgggtagccggcctgagagggtggtcggccacatggggactgagacacggccccgactcctacgggaggcagcagtgaggaatcttgggcaatgcccgaaagggtgacccagcgacgccgcgtgagggatgaagcccgaaagggtgtaaacctctgtggagggggaagaaaatcctgggttcgaataggactcagggctgacggtacccctctagaaagccccggctaactacgtgccagcagccgcggtaatacgtagggggcgagcgttgcccggaatcactgggcgtaaagggtacgtaggcgggctcgtaagtcaggggtgaaattccggggctcaactccggagctgcctctgagactgcgagccttgggtgcggaagagggaggtggaattcccggtgtagcggtgaaatgcgtagatatcgggaggaacaccagcggcgaaggcggcctcctggtccgcaaccgacgctcaggtacgaaagcgtggggagcaaacaggattagataccctggtagtccacgccctaaacgttgggtgctaggtgttggccctttagggtcagtgccgaagctaacgcgataagcaccccgcctggggagtatacccgcaagggtgaaactcaaaccaattgacgggggcccgcacaagcggtggagcatgtggtttaattcgatgcaacgcgaagaaccttacccgggcttgacatgccggtagtaggagcccgaaagggtgacgacccgtaaagccgggagccggcacaggtgctgcatggctgtcgtcagctcgtgccgtgaggtgttgggttaagtcccgcaacgagcgcaacccctgtccctagttgccagcgggtaaagccgggcactctagggagactgccagcgcaagctggaggaaggtggggatgacgtcaagtcctcatggcccttatgtccggggctacacacgtgctacaatgccggctacagcgggttccgaagccgcgaggcggaggcaatccctaaaaagccggcccagttcggatcgcagtctgcaactcgactgcgtgaagtcggaatcgctagtaatcgcgcatcagcacggcgcggtgaatacgttcccgggccttgtacacaccgcccgtcacgccatgggagccgggggcacccgaagtcgccgagctaaccccgaaaggggaggcaggcgccgaaggtgaaaccggtgactggggcgaagtcgtaacaaggtagccgtaccggaaggtgcggctggatcacctcctttt

SEQ ID NO: 2448 - DNA, 1597 bp, Candidatus Kuenenia stuttgartiensis
  ref <308>: DATABASE ACCESSION NUMBER: NCBI ACCESSION: NZ_LT934425.1
  ref <309>: DATABASE ENTRY DATE: 2019-04-01
  ref <313>: RELEVANT RESIDUES IN SEQ ID NO: (1)..(1597)
ttttatgaagggtatgatcttggctcagaacgaacgctggcggcgtggattaggcatgcaagtcgaacgaggaagtgccccgtaaggggcgcaagcctagtggcgaaagggtgagtaatgcattgataacctgcctttgagatgggaataactgcgtttcgagcaatcggaactaccgaaagggctgctaatacccaataatactataggtgcaaaagcacttgtggtcaaatgctaggaattctgttccttgtgcttaaagaggggttaatgtcctatcagctagttggtggggtaatggcctaccaaggcaaagacgggtagccggcttgagagggtggtcggccacactgggactgagacactgcccagactcctacgggaggctgcagtcgagaatctttcgcaatgcccgaaagggtgacgaagcgacgccgcgtgtgggaagaaggccttcgggttgtaaaccactgtcgggagttaggaaatgcaggtgcgttaatagcgcacttgcttgactaaggctccagaggaagccacggctaactctgtgccagcagccgcggtaatacagaggcggcaagcgttgttcggaattattgggcgtaaagagcacgtaggcggccttgcaagtcagttgtgaaagccttccgcttaacggaagaacggcatctgatactacagggcttgagtacgggaggggagagtggaacttctggtggagcggtgaaatgcgtagatatcagaaggaacgccggcggcgaaagcgactctctggtccgaaactgacgctgagtgtgcgaaagctaggggagcaaacgggattagataccccggtagtcctagccgtaaacgatgggcactaagtagaggggttttgattatttctctgccggagctaacgcattaagtgccccgcctggggagtacggccgcaaggctaaaactcaaaagaattgacgggggctcgcacaagcggtggagcatgtggcttaattcgatgcaacgcgaagaaccttaccggggcttgacatggtagaagtagaatcctgaaagggtgacgatcggtatccagtccgaagctatcacaggtgttgcatggctgtcgtcagctcgtgtcgtgagacgttgggttaagtcccctaacgagcgaaacccttgtctttagttgctaacgggtaatgctgagcactttagagagactgccgtcgttaagacggaggaaggtggggacgacgtcaagtcatcatggcccttatgtcccgggctgcacacgtgctacaatggtcggtacaaagggatgctaagtcgcgagatggtgcgaaacctataaagccgatctcagttcagattggaggctgaaactcgcctccatgaagttggaatcgctagtaatcgcggatcagctacgccgcggtgaatatgttcccgagccttgtacacaccgcccgtcaagccacccaagcaagatgcacccaaaatcgcctgcctaacccgtaagggagggaagtgcctaaggtgtgttttgtgaggaggactaagtcgtaacaaggtagtcgtaggagaacctgcggctggatcacctcctttctaagga

SEQ ID NO: 2449 - DNA, 1504 bp, Candidatus Liberibacter africanus
  ref <308>: DATABASE ACCESSION NUMBER: NCBI ACCESSION: NZ_CP004021.1
  ref <309>: DATABASE ENTRY DATE: 2019-04-01
  ref <313>: RELEVANT RESIDUES IN SEQ ID NO: (1)..(1504)
gaacatgagagtttgatcctggctcagaacgaacgctggcggcaggcctaacacatgcaagtcgagcgcgtattttatacgagcggcagacgggtgagtaacgcgtaggaatctacctttttctacgggataacgcatggaaacgtgtgctaataccgtatacgccctattgggggaaagattttattggagagagatgagcctgcgttggattagctagttggtagggtaaaggcctaccaaggctacgatctatagctggtctgagaggacgatcagccacactgggactgagacacggcccagactcctacgggaggcagcagtggggaatattggacaatgggggcaaccctgatccagccatgccgcgtgagtgaagaaggccttagggttgtaaagctctttcgccggagaagataatgacggtattcggagaagaagccccggctaacttcgtgccagcagccgcggtaatacgaagggggcgagcgttgttcggaataactgggcgtaaagggcgcgtaggcgggcgattaagttagaggtgaaatcccagggctcaaccttggaactgcctttaatactgattgtctagagttcaggagaggtgagtggaattccgagtgtagaggtgaaattcgtagatattcggaggaacaccggtggcgaaggcggctcactggcctgatactgacgctgaggcgcgaaagcgtggggagcaaacaggattagataccctggtagtccacgctgtaaacgatgagtgctagctgttgggtggtttaccattcagtggcgcagctaacgcattaagcactccgcctggggagtacggtcgcaagattaaaactcaaaggaattgacgggggcccgcacaagcggtggagcatgtggtttaattcgatgcaacgcgcagaaccttaccagcccttgacatatgttggacgatatcagagatgatattttcttttcggagactttcatacaggtgctgcatggctgtcgtcagctcgtgtcgtgagatgttgggttaagtcccgcaacgagcgcaacccctacctctagttgccatcaagtttagattttatctagatgttgggtactttatagggactgccggtgataagccggaggaaggtggggatgacgtcaagtcctcatggcccttatgggctgggctacacacgtgctacaatggtggttacaatgggttgcgaagtcgcgaggcggagctaatccccaaagtccatctcagttcggattgcactctgcaactcgagtgcatgaagttggaatcgctagtaatcgcggatcagcatgccgcggtgaatacgttctcgggccttgtacacaccgcccgtcacaccatgggagttggttttgcctgaagacggtgtgctaaccgcaagggggcagccggccacggtaaggtcagcgactggggtgaagtcgtaacaaggtagccgtaggggaacctgtggctggatcacctcctttctaa

SEQ ID NO: 2450 - DNA, 1497 bp, Candidatus Liberibacter americanus
  ref <308>: DATABASE ACCESSION NUMBER: NCBI ACCESSION: NC_022793.1
  ref <309>: DATABASE ENTRY DATE: 2019-04-01
  ref <313>: RELEVANT RESIDUES IN SEQ ID NO: (1)..(1497)
aacatgagagtttgatcctggctcagaacgaacgctggcggcaggcttaacacatgcaagtcgagcgagtacgcaagtactagcggcagacgggtgagtaacgcgtggggatctacctttttctacgggataacgcacggaaacgtgtgctaataccgtatacgcctttagagggaaagattttattggagaaagatgaacccgcgttagattagctagttggtggggtaaaggcctaccaaggcgatgatctatagctggtctgagaggacgatcagccacactgggactgagacacggcccagactcctacgggaggcagcagtggggaatattggacaatgggggcaaccctgatccagccatgccgcgtgagtgaagaaggccttagggttgtaaagctctttcgccggagaagataatgacggtaaccggagaagaagccccggctaacttcgtgccagcagccgcggtaatacgaagggggcgagcgttgttcggaataactgggcgtaaagggtgcgtaggcgggcgattaagttagaggtgaaatcccaaggctcaaccttggaactgcctttaatactgtttgtctagagttcaggagaggtgagcggaattccgagtggagaggtgaaattcgttgatattcggaggaacaccagtggcgaaggcggctcactggcctgatactgacgctgaggcacgaaagcgtggggagcaaacaggattagataccctggtagtccacgctgtaaacgatgagtgctagctgttgggtggtttaccattcagtggcgcagctaacgcgttaagcactccgcctggggagtacggtcgcaagattaaaactcaaaggaattgacgggggcccgcacaagcggtggagcatgtggtttaattcgatgcaacgcgcagaaccttaccagcccttgacatggtgggacgatatcagagatgatattttcttttcggagacccacacacaggtgctgcatggctgtcgtcagctcgtgtcgtgagatgttgggttaagtcccgcaacgagcgcaacccctgcctatatttgccatcattaagttgggaactttatagggactgccggtgataagccggaggaaggtggggatgacgtcaagtcctcatggcccttatgggctgggctacacacgtgctacaatggtggtgacagagggttgcaaagtcgcgaggcggagctaatccctaaaagccatctcagttcggattgcactctgcaactcgagtgcatgaagttggaatcgctagtaatcgcggatcagcatgccgcggtgaatacgttctcgggccttgtacacaccgcccgtcacaccatgggagttggttttgcctgaagacggtgagctaaccgtaaggaggcagccggccacggtagggtcagcgactggggtgaagtcgtaacaaggtagccgtaggggaacctgcggctggatcacctcctttctaaggaagatgttt

SEQ ID NO: 2451 - DNA, 1506 bp, Candidatus Liberibacter asiaticus
  ref <308>: DATABASE ACCESSION NUMBER: NCBI ACCESSION: NZ_QXDO01000001.1
  ref <309>: DATABASE ENTRY DATE: 2019-04-01
  ref <313>: RELEVANT RESIDUES IN SEQ ID NO: (1)..(1506)
gaacatgagagtttgatcctggctcagaacgaacgctggcggcaggcctaacacatgcaagtcgagcgcgtatgcgaatacgagcggcagacgggtgagtaacgcgtaggaatctacctttttctacgggataacgcatggaaacgtgtgctaataccgtatacgccctattgggggaaagattttattggagagagatgagcctgcgttggattagctggttggtagggtaagagcctaccaaggctacgatctatagctggtctgagaggacgatcagccacactgggactgagacacggcccagactcctacgggaggcagcagtggggaatattggacaatgggggcaaccctgatccagccatgccgcgtgagtgaagaaggccttagggttgtaaagctctttcgccggagaagataatgacggtattcggagaagaagccccggctaaacttcgtgccagcagccgcggtaatacgaaggggggcgagcgttgttcggaataactgggcgtaaagggcgcgtaggcgggcgattaagtttagaggtgaaatcccagggctcaaccttgggaactgcctttaatactggttgtctagagtttaggagaggtgagtggaattccgagtgtagaggtgaaattcgtagatattcggaggaacaccggtggcgaaggcggctcactggcctgatactgacgctgaggcgcgaaagcgtggggagcaaacaggattagataccctggtagtccacgccgtaaacgatgagtgctagctgttgggtggtttaccattcagtggcgcagctaacgcattaagcactccgcctggggagtacggtcgcaagattaaaactcaaaggaattgacgggggcccgcacaagcggtggagcatgtggtttaattcgatgcaacgcgcagaaccttaccagcccttgacatgtataggacgatatcagagatggtattttcttttcggagacctttacacaggtgctgcatggctgtcgtcagctcgtgtcgtgagatgttgggttaagtcccgcaacgagcgcaacccctgcctctagttgccatcaagtttaggtttttacctagatgttgggtactttatagggactgccggtgataagccggaggaaggtggggatgacgtcaagtcctcatggcccttatgggctgggctacacacgtgctacaatggtggttacaatgggttgcgaagtcgcgaggcggagctaatccccaaaagccatctcagttcggattgcactctgcaactcgagtgcatgaagtcggaatcgctagtaatcgcggatcagcatgccgcggtgaatacgttctcgggccttgtacacaccgcccgtcacaccatgggagttggttttgcctgaagacggtgtgctaaccgcaaggaggcagccggccacggtagggtcagcgactggggtgaagtcgtaacaaggtagccgtaggggaacctgcggctggatcacctccttt

SEQ ID NO: 2452 - DNA, 1506 bp, Candidatus Liberibacter solanacearum
  ref <308>: DATABASE ACCESSION NUMBER: NCBI ACCESSION: NZ_PKRU02000023.1
  ref <309>: DATABASE ENTRY DATE: 2019-04-01
  ref <313>: RELEVANT RESIDUES IN SEQ ID NO: (1)..(1506)
gaacatgagagtttgatcctggctcagaacgaacgctggcggcaggcttaacacatgcaagtcgagcgcttatttttaataggagcggcagacgggtgagtaacgcgtgggaatctacctttttctacgggataacgcatggaaacgtgtgctaataccgtatacgccctgagaaggggaaagatttattggagagagatgagcccgcgttagattagctagttggtggggtaaatgcctaccaaggctacgatctatagctggtctgagaggacgatcagccacactgggactgagacacggcccagactcctacgggaggcagcagtggggaatattggacaatgggggcaaccctgatccagccatgccgcgtgagtgaagaaggccttagggttgtaaagctctttcgccggagaagataatgacggtatccggagaagaagtcccggctaacttcgtgccagcagccgcggtaatacgaagggggcgagcgttgttcggaataactgggcgtaaagggcgcgtaggcgggtaattaagttaggggtgaaatcccaaggctcaaccttggaactgcctttaatactggttatctagagtttaggagaggtgagtggaattccgagtgtagaggtgaaattcgcagatattcggaggaacaccagtggcgaaggcggctcactggcctgatactgacgctgaggcgcgaaagcgtggggagcaaacaggattagataccctggtagtccacgctgtaaacgatgagtgctagctgttgggtggtttaccattcagtggcgcagctaacgcattaagcactccgcctggggagtacggtcgcaagattaaaactcaaaggaattgacgggggcccgcacaagcggtggagcatgtggtttaattcgatgcaacgcgcagaaccttaccagcccttgacatatagaggacgatatcagagatggtattttcttttcggagacctttatacaggtgctgcatggctgtcgtcagctcgtgtcgtgagatgttgggttaagtcccgcaacgagcgcaacccctgcctctagttgccatcaagtttagattttatctaaatgttgggtactttatagggactgccggtgataatccggaggaagatggggatgacgtcaagtcctcatggcccttatgggctgggctacacacgtgctacaatggtggttacaatgggttgcgaagtcgtgaggcggagctaatcccaaaaggccatctcagttcggattgcactctgcaactcgagtgcatgaagttggaatcgctagtaatcgcggatcagcatgccgcggtgaatacgttctcgggccttgtacacaccgcccgtcacaccatgggagttggttttgcttgaagacggtgcgctaaccgtaaggaggcagccggccacggtagggtcagcgactggggtgaagtcgtaacaaggtagccgtaggggaacctgtggctggatcacctcctttctaa

SEQ ID NO: 2453 - DNA, 1532 bp, Candidatus Magnetobacterium casensis
  ref <308>: DATABASE ACCESSION NUMBER: NCBI ACCESSION: NZ_JMFO01000010.1
  ref <309>: DATABASE ENTRY DATE: 2019-04-01
  ref <313>: RELEVANT RESIDUES IN SEQ ID NO: (1)..(1532)
tttaaatgagagtttgatcctggctcagagcgaacgctggcggcgtgcctaacacatgcaagtcgaacggatcatggtgaaatcgcaagagggatccatggttagtggcgcacgggtgagtaacgcgtaggtaatctgccttcaggaccggaacaaccattggaaacgatggctaatgccggataagaccacgtatagcaatgtatggggtaaaaggagtaattcacctggagatgagcctgcgtcctatcaggtagttggtaaggtaatggcttaccaagcctaagacgggtagccggtctgagaggatgaacggccacactggaactgagacacggtccagactcctacgggaggcagcagtgaggaattttgcgcaatgggggaaaccctgacgcagcgacgccgcgtggaggaagaaggccttcgggttgtaaactccttttgtagggaaagatgatgacggtaccttacgaataagccacggctaactctgtgccagcagccgcggtaagacagaggtggcaagcgttgctcggaattactgggcttaaagggtgcgtaggcggttagataagtttggggtggaatgctcgggctcaacccgggaattgccttgaaaactgtttaacttgagtaagcgaggggatggcggaattcctggtgtagcggtgaaatgcgtagatatcaggaggaaggccggtggcgaaggcggccatcaggcgcttaactgacgctgaggcacgaaagcgtggggatcaaacaggattagataccctggtagtccacgccctaaacggtgggtactaggtatagggctcgatagggttctgtgccgaagggaaaccaataagtaccccgcctgggaagtacggccgcaaggttgaaactcaaaggaattgacgggggcccgcacaagcggtggagcatgtggtttaattcgacgcaacgcgaagaaccttacctgggtttgacatgtaagtggtaggagtccgaaaggataacgactcccgcaagggagagcttgcacaggtgctgcatggctgtcgtcagctcgtgccgtgaggtgttgggttaagtcccgcaacgagcgcaacccttattctctgttgccatcgggtaaagccgggcactctgagaaaactgccggcgatgagttggaggaaggtggggatgacgtcaagtcatcatggcccttatgtccagggctacacacgtgctacaatggctattacagagggaagcaagatcgcgaggtggagcaaatccctaaaaatagtcttagttgggatcggagtctgcaactcgactccgtgaacgtggaatcgctagtaatcgcggatcagctacgccgcggtgaatacgttcccgggccttgtacacaccgcccgtcacaccacgaaagtctgctgtacccgaagtgggtgagctaaccagcaatggaggcagcttacgaaggtatggtaggtaattggggtgaagtcgtaacaaggtagccgtaggggaacctgcggctggatcacctcctttct

SEQ ID NO: 2454 - DNA, 407 bp, Candidatus Marinimicrobia bacterium
  ref <308>: DATABASE ACCESSION NUMBER: NCBI ACCESSION: NZ_SCKJ01000008.1
  ref <309>: DATABASE ENTRY DATE: 2019-04-01
  ref <313>: RELEVANT RESIDUES IN SEQ ID NO: (1)..(407)
aacggagagtttgatcctggctcaggacgaacgctggcggcgtgcttaacacatgcaagtcaaggagaacgccaccttcgggtggttattaaactggcgaacgggtgagtaacgcgtgggcaacctgcccctcagattgggataaccccgggaaaccgggattaataccggatacagccctgcaccacaagttgcaggatgaaagcgggcttcggctcgcgctgggggatgggcctgcgtctgattagcttgttggtggggtaatggcccaccaaggcgacgatcagtagctggttcgagaggatgatcagccacactgggactgagatacggcccagactcctacgggaggcagcagtggggaattttgcgcaatgggcgaaagcctgacgcagcaacgccgcgtg

SEQ ID NO: 2455 - DNA, 1501 bp, Candidatus Marinoinvertebrata rohwerii
  ref <308>: DATABASE ACCESSION NUMBER: NCBI ACCESSION: NZ_RXFM01000107.1
  ref <309>: DATABASE ENTRY DATE: 2019-04-01
  ref <313>: RELEVANT RESIDUES IN SEQ ID NO: (1)..(1501)
tcaaacttgagagtttgatcctggctcagagtgaacgctagtggcgtgcttaacacatgcaagtcgaacggacgatatttgtgcttgcacaaataaagttagtggcaaacgggtgagtaatacatgagaattttccttgcagtacggaataactattggaaacagtagctaataccgtatattgccgagaggtgaaagatttatcgctgcaagataagcccatgcaagattagcttgttggtaaggtaatggcttaccaaggctacgatctttagctggtttgagaggatgatcagccacactggaacttagacacggtccagactcctacgggaggcagcagtgaggaatattggacaataggcgaaagcctgatccagcgacgtcacgtgaatgatgaaggccttagggttgtaaaattcttttagtggagaagataatgacggtatccacagaaaaagtcccggctaacttcgtgccagcagccgcggtaatacgaagggggcaagcgttactcggaattattgggcgtaaagcgtgcgtaggcggttttataagttgaaagtgaaagcctttggctcaaccaaagaattgcttacaaaactgtaaaactagagtattagagaggatagaagaattcctgatgtaggggtgaaatccgtagatatcaggaggaatatcgaaggcgaaagcatctgtctggctaaatactgacgctgttgcacgaaagcgtggggagcaaacaggattagataccctggtagtccacgcagtaaacgatgagtgctagatgttagaactatgttttagcgtcgaagctaacgcattaagcactccgcctgggaactacgatcgcaaggttaaaactcaaaggaattgacggggacccgcacaagcggtggaacatgtggtttaattcgatgctacgcgaaaaaccttaccaagtcttgacatgttagtcgtatgattaggaaactagtcagtcagttcggctggactatcacaggtgttgcatggctgtcgtcagctcgtgtcgtgagatgttgggttaagtcccgcaacgagcgcaacccttatctttaattgccaacaggttatgctgggaactttaaagaaactgccaatggagaattggaggaaggtgaggataatgtcaagtcagtatggcccttatgacttgggctacacacgtgttacaatggtagccacaatatgatgcaatagggtgacctggagcaaatctataaaagctacctcagttcggattgtaccctgcaactcgggtgcatgaagttggaatcgctagtaatcgcagatcagcacgctgcggtgaatacgttcccgggtcttgtacacactgcccgtcaagccatggaagttaaattttccttaagtaaatgagctaactgcaaagaggcagtttaccaaggagagtttgatgactgaggttaagtcgtaacaaggtagccgtaggggaacctgcggctggattacctcctaa

SEQ ID NO: 2456 - DNA, 1562 bp, Candidatus Methylomirabilis lanthanidiphila
  ref <308>: DATABASE ACCESSION NUMBER: NCBI ACCESSION: NZ_ULHC01000010.1
  ref <309>: DATABASE ENTRY DATE: 2019-04-01
  ref <313>: RELEVANT RESIDUES IN SEQ ID NO: (1)..(1562)
tttggagagtttgatcctggctcagaacgaacgctggcggcgtgcctaacacatgcaagtcgagcgtgaaagtcccggcaacgggatgagtaaagcggcaaacgggtgagtaacgcgtaggtaatctatccttcggaccgggataacctgctgaaaggtgggctaataccgggtaatgttcctgtgaggatctcatgggaaccaaagggggcgagcgtaagcagcttccgccaaaggaggagcctgcgtccgattagctagttggtggggtaatggcctaccaaggcgacgatcggtagccggcctgagagggcgaccggccacactggaactgagacacggtccagactcctacgggaggcagcagtggggaatattgcgcaatgggcgaaagcctgacgcagcgacgccgcgtgggtgatgaaggccttcgggttgtaaagccctgtcgggtggaacgaatgacttggcggcaaataaccgccaggtgtgacggtaccaccgaaggaagccccggctaactacgtgccagcagccgcggtaagacgtagggggcgagcgttgttcggatttactgggcgtaaagcgcgcgtaggcggccaggtaagtcggttgtgaaatccctcggctcaaccgaggtcccgcatccgatactgtctggctcgagtctaggagaggaaagcggaattcccagtgtagcggtgaaatgcgtagatattgggaggaacaccggtggcgaaggcggctttccggactagtactgacgctgaggcgcgaaagctaggggagcgaacgggattagataccccggtagtcctagccgtaaacgatgggcactaggtgtgggaggtattgaccccttccgcgccgaagctaacgcattaagtgccccgcctggggagtacggccgcaaggctaaaactcaaaggaattgacgggggcccgcacaagcggtggagcatgtggtttaattcgacgcaacgcgaagaaccttaccagggcttgacatcccacgaacctgcctgaaagggcggggtgcccgcaagggagcgtggagacaggtggtgcatggctgtcgtcagctcgtgtcgtgagatgttgggttaagtcccgcaacgagcgcaaccctcacccctagttgcgaccgggttatgccgagcactcgaggggaactgccagcgtcaagctggaggaaggcggggatgacgtcaagtcatcatgccccttacgccctgggctacacacgtgctacaatggccagtacaaagggacgcgagactgcgaagtggagctaatcccaaaaagctggtctaagttcagattgcagtctgcaactcgactgcatgaaggaggaatcgctagtaatcgcgcatcagcacggcgcggtgaatacgttcccgggccttgtacacaccgcccgtcacaccacgaaagctgtctgtactcgaagtcgctgagctaacccgcaagggaggcaggcgccgaaggtatggtcagtgattggggtgaagtcgtaacaaggtagccgtacgggaacgtgcggctggatcacctcctttcta

SEQ ID NO: 2457 - DNA, 1560 bp, Candidatus Methylomirabilis limnetica
  ref <308>: DATABASE ACCESSION NUMBER: NCBI ACCESSION: NZ_NVQC01000015.1
  ref <309>: DATABASE ENTRY DATE: 2019-04-01
  ref <313>: RELEVANT RESIDUES IN SEQ ID NO: (1)..(1560)
tggagagtttgatcctggctcagaacgaacgctggcggcgtgcctaacacatgcaagtcgagcgagaaagtcccggcaacgggatgagtaaagcggcaaacgggtgagtaacgcgtgggtaatctaccctacggatcgggataacctgccgaaaggtggactaataccggatgatgttcttgcggtgattccgtgggaaccaaagggggcgagcgtaagcagctctcaccgaaggaggagcctgcgtccgattagctagttggtggggtaatggcctaccaaggcgacgatcggtagccggcctgagagggcgatcggccacactggaactgagacacggtccagactcctacgggaggcagcagtggggaatattgcgcaatgggcgaaagcctgacgcagcgacgccgcgtgggtgatgaaggccttcgggtcgtaaagccctgtctggtggaacgaaacgcctggcggccaatacccgctgggtttgacggtaccaccgaaggaagccccggctaactacgtgccagcagccgcggtaagacgtagggggcgagcgttgttcggatttactgggcgtaaagcgcgcgtaggcggccagataagtcgggtgtgaaagccctcggctcaaccgaggttccgcatccgatactgcttggctggagtctaggagaggagagcggaattcccagtgtagcggtgaaatgcgtagatattgggaggaacacccgtggcgaaggcggctctctggactagtactgacgctgaggcgcgaaagctaggggagcgaacgggattagataccccggtagtcctagccgtaaacgatgggcactaggtgtgggaggtattgaccccttccgcgccgaagctaacgcattaagtgccccgcctggggagtacggccgcaaggctaaaactcaaaggaattgacgggggcccgcacaagcggtggagcatgtggttcaattcgacgcaacgcgaagaaccttaccagggcttgacatcccacgaacctgcctgaaagggcggggtgcccgcaagggagcgtggagacaggtggtgcatggctgtcgtcagctcgtgtcgtgagatgttgggttaagtcccgcaacgagcgcaaccctcacccctagttgccaccgggtaatgccgagcactcgaggggaactgccagcgtcaagctggaggaaggcggggatgacgtcaagtcatcatgccccttacgtcctgggctacacacgtgctacaatggccggtacaaagggatgcgagaccgcgaggtggagccaatcccaaaaagctggtctaagttcggattgcagtctgcaactcgactgcatgaagtaggaatcgctagtaatcgcgcatcagcacggcgcggtgaatacgttcccgggccttgtacacaccgcccgtcacaccacgaaagctggctgtactcgaagtcgctgagccaacccgcaagggaggcaggcgccgaaggtatggttagtgattggggtgaagtcgtaacaaggtagccgtacgggaacgtgcggctggatcacctcctttcta

SEQ ID NO: 2458 - DNA, 1499 bp, Candidatus Micropelagos thuwalensis
  ref <308>: DATABASE ACCESSION NUMBER: NCBI ACCESSION: NZ_AWXE01000005.1
  ref <309>: DATABASE ENTRY DATE: 2019-04-01
  ref <313>: RELEVANT RESIDUES IN SEQ ID NO: (1)..(1499)
aaacttaagagtttgatcctggctcagaacgaacgctggcggcaggcttaacacatgcaagtcgaacgagaagcttcttcggaagtggacagtggcagacgggtgagtaacgcgtgggaatttgcccagaggttcggaacaaccattggaaacgatggctaataccggataagcccttcgggggaaagatttatcgcctttggataagcccgcgtaagattagctagttggtgaggtaacggctcaccaaggcgacgatctttagctggtctgagaggatgatcagccacattgggactgagacacggcccagactcctacgggaggcagcagtggggaatattgcgcaatgggggaaaccctgacgcagccatgccgcgtgagtgacgaaggccttagggttgtaaagctctttcgctagggaagataatgacggtacctagtaaagaagccccggctaactccgtgccagcagccgcggtaatacggagggggctagcgttgttcggaatcactgggcgtaaagcgcgcgtaggcggattgattagttgggggtgaaatcccggggctcaacctcggaactgccttcaatactgtcagtcttgagttcgtgagaggtaagtggaattccgagtgtagaggtgaaattcgtagatattcggaagaacaccagtggcgaaggcgacttactggcacgatactgacgctgaggtgcgaaagcgtggggagcaaacaggattagataccctggtagtccacgccgtaaacgatgaatgctagctgtcgggcagttaactgctcggtggcgcagctaacgcattaagcattccgcctggggagtacggtcgcaagactaaaactcaaaggaattgacgggggcccgcacaagcggtggagcatgtggtttaattcgaagcaacgcgcagaaccttaccagcccttgacatcccggtcgcggttttcagagatgaattccttcagttcggctggaccggtgacaggtgctgcatggctgtcgtcagctcgtgtcgtgagatgttgggttaagtcccgcaacgagcgcaaccctcgcctttagttgccagcatttagttgggcactctagagggactgccggtgataagccggaggaaggtggggatgacgtcaagtcctcatggcccttatgggctgggctacacacgtgctacaatggcggcgacagagggttgcgatcccgcaagggcaagctaatccccaaaagccgtctcagttcggattgttctctgcaactcgagagcatgaaggtggaatcgctagtaatcgcagatcagcatgctgcggtgaatacgttcccgggccttgtacacaccgcccgtcacaccatgggagttggttctacccgaaggtggtgcgctaaccgtaaggaggcagccaaccacggtaggattagcgactggggtgaagtcgtaacaaggtagccgtaggggaacctgcggctggatcacctcctttctaag

SEQ ID NO: 2459 - DNA, 1507 bp, Candidatus Midichloria mitochondrii
  ref <308>: DATABASE ACCESSION NUMBER: NCBI ACCESSION: NC_015722.1
  ref <309>: DATABASE ENTRY DATE: 2019-04-01
  ref <313>: RELEVANT RESIDUES IN SEQ ID NO: (1)..(1507)
caggataaaacatgagagtttgatcctggctcagagtgaacgctggcggcgtgcttaacacatgcaagtcgaacgggcaagagctgtagcgatacagagttctgctagtggcagacgggtgagtagtacatgggaatctaccttgcagtgcgaaataacagttggaagcaattgctaatgtcgcatatagccgagaggtgaaagatttatcgctgcaagacgagcccatgcaggattagctagttggtgaggtaatggctcaccaaggcaacgatctttagttggtctgagaggatgatcagccacactggaactgagacacggtccagactcctacgggaggcagcagtggggaatattggacaatgggcgcaagcctgatccagcgacgccgcgtgagtgaagaaggccttcgggttgtaaagctcttttagtggggaagataatgacggtacccacagaaaaagccccggctaacttcgtgccagcagccgcggtaatacgaagggggctagcgttactcggaattattgggcgtaaagcgtgcgtaggctgcttagtaagtcaaaagtgaaagccttgggctcaacctaagaattgcttttgaaactaccaagcttgagtactgtaggggatagcggaattcctagtgtaggggtgaaattcgtagatattaggaggaacaccggaggcgaaagcggttatctggacagttactgacgctgttgcacgaaagcgtggggagcaaacaggattagataccctggtagtccacgcagtaaacgatgagtgctagatgttgggatttaagtctcagtgtcgcagctaacgcattaagcactccgcctggggagtacggtcgcaagattaaaactcaaaggaattgacggggacccgcacaagcggtggaacatgtggtttaattcgatgctacgcgaaaaaccttaccaggccttgacatggtgatcatatggctgcgaaagcagttagtcggttcggccggatcgtcacaggtgttgcatggctgtcgtcagctcgtgtcgtgagatgttgggttaagtcccgcaacgagcgcaacccttatccttagttgccagcgagtgatgtcgggaactttaaggaaactgccggtgataagccggaggaaggtggggatgacgtcaagtcagcatggcccttacggcctgggctacacacgtgttacaatggtggtgacaaaaagaagcaatagggcgacctggagcagatcttataaaagctatctcagttcggattgcactctgcaactcgggtgcatgaagtcggaatcgctagtaatcgcagatcagcatgctgcggtgaatacgttcccgggtcttgtacacactgcccgtcacgccatgggagtcggttttgcctgaagtaggtgcgctaaccgcaaggaggcagcttaccacggtaaggttgacgactggggtgaagtcgtaacaaggtagccgtaggggaacctgcggctggattacctcct

SEQ ID NO: 2460 - DNA, 1514 bp, Candidatus Neoehrlichia lotoris
  ref <308>: DATABASE ACCESSION NUMBER: NCBI ACCESSION: NZ_LANX01000001.1
  ref <309>: DATABASE ENTRY DATE: 2019-04-01
  ref <313>: RELEVANT RESIDUES IN SEQ ID NO: (1)..(1514)
aatcaaacttgagagtttgatcctggctcagaacgaacgctggcggcaagcttaacacatgcaagtcgaacgaattataattatagtttactatagttatagttagtggcagacgggtgagtaatgcataggaatctgcctagtagtatggaatagctgttagaaatgacaggtaataccgtataatccctgcgggggaaagatttatcgctattagatgagcctatgttagattagctagttggtgaggtaatagcttaccaaggctatgatctatagctggtctgagaggacgatcagccacactggaactgagatacggtccagactcctacgggaggcagcagtggggaatattggacaatgggcgcaagcctgatccagctatgccgcatgagtgaagaaggccttagggttgtaaaactctttcagcagggaagataatgacggtacctgcagaagaagtcccggcaaactccgtgccagcagccgcggtaatacggagggggcaagcgttgttcggaattattgggcgtaaagggcatgtaggcggtttaataagttaaaagtgaaataccaaggcttaaccttggagctgcttttaatactgttagactagagatcgagagaggatagtggaattcctagtgtagaggtgaaattcgtagatattaggaggaacaccagtggcgaaggcgactatctggctcagttctgacgctgaggtgcgaaagcgtggggagcaaacaggattagataccctggtagtccacgctgtaaactatgagtgctaaatgtggggatattttatctctgtattgtagctaacgcgttaagcactccgcctggggactacggtcgcaagactaaaactcaaaggaattgacggggacccgcacaagcggtggagcatgtggtttaattcgatgcaacgcgaaaaaccttaccactttttgacatgaaggtcgtatcttttttaacataaagagtcagttcggctggaccttacacaggtgctgcatggctgtcgtcagctcgtgtcgtgagatgttgggttaagtcccgcaacgagcgtaacccttgtccttagttgccaacaggtaatgctgggaactctaaggaaactgccagtgataaactggaggaaggtgaggatgatgtcaagtcagcacggcccttataaggtgggctacacacgtgctacaatggcaactacaataggttgcaagatcgtaagattgagctaatccataaaagttgtctcagttcggattgccctctgcaactcgagagcatgaagccggaatcgctagtaatcgtggatcagcatgccacggtgaatacgttctcgggtcttgtacacactgcccgtcatgccctggaaattggtttaactcgaagctggtgagctaaccgtaaggaggcagccatttaaggttggatcagtgactagggtgaagtcgtaacaaggtagctgtaggtgaacctgcggctggattacctccttttaggct

SEQ ID NO: 2461 - DNA, 1543 bp, Candidatus Nitrospira inopinata
  ref <308>: DATABASE ACCESSION NUMBER: NCBI ACCESSION: NZ_LN885086.1
  ref <309>: DATABASE ENTRY DATE: 2019-04-01
  ref <313>: RELEVANT RESIDUES IN SEQ ID NO: (1)..(1543)
tttttgagagtttgatcctggctcagaacgaacgctggcggcgcgcctaatacatgcaagtcgagcgagaaggcgtcgcaagacgcttgtaaagcggcgaacgggtgaggaatacatgggtaacctaccctggagtggggaataaccagccgaaaggttggctaataccgcgtacgattcccggactgcggttcgggaaagaaagcgctaccgtgggtagcgcgctcttggatgggctcatgtcctatcagcttgttggtgaggtaacggctcaccaaggcttcgacgggtagctggtctgagaggacgatcagccacactggcactgcgacacgggccagactcctacgggaggcagcagtaaggaatattgcgcaatgggcgaaagcctgacgcagcgacgccgcgtgggggatgaaggtcttcggattgtaaacccctttcgggagggaagatggagcgggtaaccgctcggacggtacctccagaagcagccacggctaacttcgtgccagcagccgcggtaatacgaaggtggcaagcgttgttcggatttactgggcgtacagggagcgtaggcggttgggtaagccctccgtgaaatctccgggcctaacccggaaagtgcggaggggactgcttggctagaggatgggagaggagcgcggaattcccggtgtagcggtgaaatgcgtagagatcgggaggaaggccggtggcgaaggcggcgctctggaacatttctgacgctgaggctcgaaagcgtggggagcaaacaggattagataccctggtagtccacgccctaaacgatggatactaagtgtcggcgggttaccgccggtgccgcagctaacgcagtaagtatcccgcctgggaagtacggccgcaaggttgaaactcaaaggaattgacgggggcccgcacaagcggtggagcatgtggtttaattcgacgcaacgcgaagaaccttacccaggctggacatgcaggtagtaggagggtgaaagcctgacgaggtagcaataccgagcctgctcaggtgctgcatggctgtcgtcagctcgtgccgtgaggtgttgggttaagtcccgcaacgagcgcaacccctgtcttcagttaccaacgggtcatgccgggaactctggagagactgcccaggagaacggggaggaaggtggggatgacgtcaagtcagcatggcctttatgcctggggctacacacgtgctacaatgaccggcacaaagggttgcaaacccgcaaggggaagccaatcccaaaaaaccggcctcagttcagattgaggtctgcaactcgacctcatgaaggcggaatcgctagtaatcgcggatcagcacgccgcggtgaatacgttcccgggccttgtacacaccgcccgtcacaccacgaaagtttgttgtacctgaagtcgttggcgccaaccgtaaggaggcagacgcccacggtatgaccgatgattggggtgaagtcgtaacaaggtagccgtaggggaacctgcggctggatcacctcctttctaa

SEQ ID NO: 2462 - DNA, 1500 bp, Candidatus Nucleicultrix amoebiphila
  ref <308>: DATABASE ACCESSION NUMBER: NCBI ACCESSION: NZ_CP008743.1
  ref <309>: DATABASE ENTRY DATE: 2019-04-01
  ref <313>: RELEVANT RESIDUES IN SEQ ID NO: (1)..(1500)
aacttgagagtttgatcctggctcagaacgaacgctggcggcatgcctaacacatgcaagtcgaacgcagtagcaatactgagtggcggacgggtgaggaacacgtgggaacatgccgaatggtgggggataactgcgggaaactgcagctaataccgcataagccctgagggggaaagatttatcgccattcgattggcccgcggcagattaggtagttggtagggtaaaggcctaccaagccgatgatctgtaactggtctgagaggatgaccagtcacactgggactgagacacggcccagactcctacgggaggcagcagtggggaatattggacaatgggggaaaccctgatccagcaatgccgcgtgagtgaagaaggccttcgggttgtaaagctcttttgcctgtgacgatgatgacagtaacaggagaataagccccggctaactccgtgccagcagccgcggtaagacggagggggctagcgttgttcggaatgactgggcgtaaagggcgcgtaggcggcaaatcaagtcaggtgtgaaagccttgggctcaacccaagaattgcgcttgatactggttagctagaggatggaagagaaaagcggaattcctagtgtagaggtgaaattcgtagatattaggaagaacaccagaggcgaaggcggctttttggtccatatctgacgctgaggcgcgaaagcgtggggagcaaacaggattagataccctggtagtccacgctgtaaacgatgagtgctagacgttagggggcaacccttagtgtcacagttaacacgttaagcactccgcctggggagtacggtcgcaagattaaaactcaaaggaattgacgggggcccgtacaagcggtggagcatgtggtttaattcgacgcaacgcgaaaaaccttaccagctcttgacatggggattaaggagatcagagatgatttccgtcggttcggccggatcccacacaggtgctgcatggctgtcgtcagctcgtgtcgtgagatgttgggttaagtcccgcaacgagcgcaaccctcatctttagttgccaacaggtagggctgggcactctaaagaaactgccggtgacaaaccggaggaaggtggggatgacgtcaagtcctcatggcccttatgggctgggctacacacgtgctacaatggcggtgacagaggggagcgaaagggtgacctggagccaatcccttaaaagccgtctcagttcagattgcactctgcaactcgagtgcatgaagttggaatcgctagtaatcgcagatcagcatgctgcggtgaatacgttctcgggccttgtacacaccgcccgtcacgccatgggagtttacttcacccgaaggcggtgagccaaccgaaagggggcagccgaccacggtggggtcaatgactggggcgaagtcgtaacaaggtagccgtaggggaacctgcggctggatcacctcctttctaaggaagctttt

SEQ ID NO: 2463 - DNA, 1502 bp, Candidatus Odyssella thessalonicensis
  ref <308>: DATABASE ACCESSION NUMBER: NCBI ACCESSION: NZ_AEWF01000006.1
  ref <309>: DATABASE ENTRY DATE: 2019-04-01
  ref <313>: RELEVANT RESIDUES IN SEQ ID NO: (1)..(1502)
caacatgagagtttgatcctggctcagaacgaacgctggcggcatgcttaacacatgcaagtcgaacggacttgttgacttcggttaataagttagtggcagacgggtgagtaacgcgtgggaatgtaccaattggttcggaataactacgggaaactgtagctaatactggataagcccgagaggggaaagatttatcgccaattgagcagcccgcgttagattaggtagttggtggggtaaaagcctaccaagcctgcgatctatagctggtctgagaggatgatcagccacactgggactgagacacggcccagactcctacgggaggcagcagtggggaatattggacaatgggggcaaccctgatccagcaatgccgcgtgagtgatgaaggccttcgggttgtaaagctcttttgtcagggaagatgatgacggtacctgacgaataagctccggctaacttcgtgccagcagccgcggtaatacgaagggagctagcgttgttcggaattactgggcgtaaagggcgcgtaggcggccttgtaagttagatgtgaaagccccgggcttaacctgggaactgcatttaagactgcaaagcttgaggacgagagaggaaagtggaattgtgagtgtagaggtgaaattcgtagatattcacaagaacaccagtggcgaaggcgactttctggctcgtatctgacgctaaggcgcgaaagcgtggggagcaaacaggattagataccctggtagtccacgctgtaaacgatgagtgctagatgttggtcttcggatcagtatcgcagctaacgcattaagcactccgcctggggagtacggtcgcaagattaaaactcaaaggaattgacgggggcccgcacaagcggtggagtatgtggtttaattcgaagcaacgcgcaaaaccttaccagcctttgacatggtgattaaggagatgagagatcatttctgtcggttcggccggatcacacacaggtgctgcatggctgtcgtcagctcgtgtcgtgagatgttgggttaagtcccgcaacgagcgcaaccctcatcgttagttgctaacaggtatggctgagcactctagcgaaactgccggtgacaaaccggaggaaggtggggatgacgtcaagtcctcatggcccttataggctgggctacacacgtactacaatggtggtgacagtaggttgcgaaagggagacctggagccaatcctcaaaaaccatctcagttcagattgtccgctgcaactcgcggacatgaagtcggaatcgctagtaatcgtagatcagcatgctacggtgaatacgttctcgggccttgtacacaccgcccgtcacaccatgggagttggttctaccttaagccggtgcgctaaccgtaaggaggcagccgtccacggtagggtcagcgactggggtgaagtcgtaacaaggtagccgtaggggaacctgcggctggatcacctcctttctaagg

SEQ ID NO: 2464 - DNA, 1506 bp, Candidatus Paracaedibacter acanthamoebae
  ref <308>: DATABASE ACCESSION NUMBER: NCBI ACCESSION: NZ_CP008941.1
  ref <309>: DATABASE ENTRY DATE: 2019-04-01
  ref <313>: RELEVANT RESIDUES IN SEQ ID NO: (1)..(1506)
caacatgagagtttgatcctggctcagaacgaacgctggcggcatgcttaacacatgcaagtcgaacggacttattgacttcggttaataagttagtggcagacgggtgagtaacgcgtgggaatgtaccgattggttcggaataactacgggaaactgtagctaatactggataagccctgagggggaaagatttatcgccaattgagcagcccgcgttagattaggtagttggtggggtaatggcctaccaagcctgcgatctatagctggtctgagaggatgatcagccacactgggactgagacacggcccagactcctacgggaggcagcagtggggaatattggacaatgggggaaaccctgatccagcaatgccgcgtgagtgatgaaggccttcgggttgtaaagctcttttgtcagggaagatgatgacggtacctgacgaataagctccggctaacttcgtgccagcagccgcggtaatacgaagggagctagcgttgttcggaattactgggcgtaaagggcgcgtaggcggccttgtaagttagatgtgaaagccccgggcttaacctgggaactgcatttaagactgcaaagcttgaggacgagagaggaaagtggaattgtgagtgtagaggtgaaattcgtagatattcacaagaacaccagtggcgaaggcgactttctggctcgtatctgacgctaaggcgcgaaagcgtggggagcaaacaggattagataccctggtagtccacgctgtaaacgatgagtgctagatgttggtcttcggatcagtatcgcagctaacgcattaagcactccgcctggggagtacggtcgcaagattaaaactcaaaggaattgacgggggcccgcacaagcggtggagtatgtggtttaattcgaagcaacgcgcaaaaccttaccagcctttgacatggtgattaaggagatgagagatcatttctgtcggttcggccggatcacacacaggtgctgcatggctgtcgtcagctcgtgtcgtgagatgttgggttaagtcccgcaacgagcgcaaccctcattgttagttgctaacaggtatggctgagcactctaacgaaactgccggtgacaaaccggaggaaggtggggatgacgtcaagtcctcatggcccttataggctgggctacacacgtactacaatggtggtgacagtaggttgcgaaagggaaacctggagccaatcctcaaacaccatctcagttcagattgtccgctgcaactcgcggacatgaagtcggaatcgctagtaatcgtagatcagcatgctacggtgaatacgttctcgggccttgtacacaccgcccgtcacaccatgggagttggttttaccttaagccggggtgctaaccgcaaggaggcagccgtccacggtagggtcagcgactggggtgaagtcgtaacaaggtagccgtaggggaacctgcggctggatcacctcctttctaaggaaaa

SEQ ID NO: 2465 - DNA, 1517 bp, Candidatus Paracaedibacter symbiosus
  ref <308>: DATABASE ACCESSION NUMBER: NCBI ACCESSION: NZ_JQAK01000004.1
  ref <309>: DATABASE ENTRY DATE: 2019-04-01
  ref <313>: RELEVANT RESIDUES IN SEQ ID NO: (1)..(1517)
acaggaaaaaacatgagagtttgatcctggctcagaacgaacgctggcggtatgcttaacacatgcaagtcgaacgaacctattgacttcggttgataagttagtggcagacgggtgagtaacgcgtgggaatgtaccctttagttcggaataactacgggaaactgtagctaataccggataagcccttcgggggaaagatttatcgctaaaggaacagcccgcgttagattaggtagttggtgaggtaaaagctcaccaagccgacgatctatagctggtttgagaggatgatcagccacactgggactgagacacggcccagactcctacgggaggcagcagtggggaatattggacaatgggggcaaccctgatccagcaataccgcgtgagtgaagaaggccttcgggttgtaaagctcttttaccggggaagataatgacggtacccggggaataagctccggctaacttcgtgccagcagccgcggtaatacgaagggagctagcgttgttcggaattactgggcgtaaagggcgcgtaggcggccttgtaagtcagatgtgaaagccccgggctcaacctgggaactgcatttgatactgcaaggctagagatcgagagaggaaagtggaattacgagtgtagaagtgaaattcgtagatattcgtaggaacaccagtggcgaaggcgactttctggctcgatactgacgctaaagcgcgaaagcgtggggagcaaacaggattagataccctggtagtccacgctgtaaacgatgagtgctagatgttaggagggtaaccttttagtgtcgcagctaacgcaataagcactccgcctggggagtacggtcgcaagattaaaactcaaaggaattgacgggggcccgcacaagcggtggagtatgtggtttaattcgaagcaacgcgaaaaaccttaccggctcttgacatggtgattaaggagatgagagatcatttctgtcggttcggccggatcacacacaggtgctgcatggctgtcgtcagctcgtgtcgtgagatgttgggttaagtcccgcaacgagcgcaaccctcattgttagttgccatcaggtttggctgggcactctaacaaaactgccgatgataagtcggaggaaggtggggatgacgtcaagtcctcatggcccttatgggccgggctacacacgtactacaatggtggtgacaacaggaagcgacggggcaaccctgagcgaatcccaaaaagccatctcagttcggattgttctctgcaactcgagagcatgaagtcggaatcgctagtaatcgcagatcagcatgctgcggtgaatacgttctcgggccttgtacacaccgcccgtcacaccatgggaattggtcttaccttaagccggtgcgctaaccttcgggaggcagccgaccacggtagggtcagtaactggggtgaagtcgtaacaaggtagccgtaggggaacctgcggctggatcacctcctttctaaggaaa

SEQ ID NO: 2466 - DNA, 1544 bp, Candidatus Pectobacterium maceratum
  ref <308>: DATABASE ACCESSION NUMBER: NCBI ACCESSION: NZ_PDVZ01000017.1
  ref <309>: DATABASE ENTRY DATE: 2019-04-01
  ref <313>: RELEVANT RESIDUES IN SEQ ID NO: (1)..(1544)
aaattgaagagtttgatcatggctcagattgaacgctggcggcaggcctaacacatgcaagtcgagcggtagcacagaagagcttgctctttgggtgacgagcggcggacgggtgagtaatgtctgggaaactgcctgatggagggggataactactggaaacggtagctaataccgcataacctcgcaagagcaaagagggggaccttcgggcctctcgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcggtaaggttaataaccttatcgattgacgttactcgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaattagctagagatagctgagtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacc

SEQ ID NO: 2467 - DNA, 1484 bp, Candidatus Pelagibacter sp. HIMB1321
  ref <308>: DATABASE ACCESSION NUMBER: NCBI ACCESSION: NZ_LT840186.1
  ref <309>: DATABASE ENTRY DATE: 2019-04-01
  ref <313>: RELEVANT RESIDUES IN SEQ ID NO: (1)..(1484)
ttaaacttgagagtttgatcatggctcagaacgtacgctggcggcacgcttaacacatgcaagtcgaacgaagtagcaatacttagtggcagacgggtgagtaacatgtgggtatctgccctttggcctggaataacacgaggaaacttgtgctaataccggataagtctttacggagaaagctttatgcaccattggatgagcccgcacttgattagtttgttggtggggtaatggcctaccaagactgtgatcaatagctgatttgagaggatgatcagccacattgggactgagacacggcccaaactcctacgggaggcagcagtggggaatcttgcacaatggaggaaactctgatgcagcgatgccgcgtgagtgaagaaggcccttgggttgtaaagctctttcgtcggggaagaaaatgactgtacccgaataagaaggtccggctaacttcgtgccagcagccgcggtaatacgaagggacctagcgtagttcggaattactgggcttaaagagttcgtaggtggttgaaaaagttagtggtgaaatcccagagcttaactctggaactgccattaaaacttttcagctagagtatgatagaggaaagcagaatttctagtgtagaggtgaaattcgtagatattagaaagaataccaattgcgaaggcagctttctggatcattactgacactgaggaacgaaagcatgggtagcgaagaggattagataccctcgtagtccatgccgtaaacgatgtgtgttagacgttggaaatttattttcagtgtcgcagcgaaagcgataaacacaccgcctggggagtacgaccgcaaggttaaaactcaaatgaattgacggggacccgcacaagtagtggagcatgtggtttaattcgaagatacgcgcagaaccttaccaacacttgacatgttcgtcgcgactctaagagattagagttttcggttcggccggacgaaacacaggtgctgcatggctgtcgtcagctcgtgtcgtgagatgttgggttaagtcccgcaacgagcgcaaccctcacttttagttgccatcattaagttgggcactctgaaagaactgccagtgataagctggaggaaggtggggatgacgtcaagtcctcatggcccttacgtgttgggctacacacgtgctacaatggtatctacaacaggaagcaagactgcgaggtcaagcaaatccttaaaagatacctcagttcggattgcactctgcaactcgagtgcatgaagctggaattactagtaatcgtggatcagcgtgccacggtgaatgcgttcccgggtcttgtacacaccgcccgtcacaccatgggagttggttctaccttaaggcaaggtttcaaacccttgaccacggtatagtcagcgactggggtgaagtcgtaacaaggtagccgtaggggaacctgcggctggattacctcctttctaagga

SEQ ID NO: 2468 - DNA, 1484 bp, Candidatus Pelagibacter sp. HTCC7211
  ref <308>: DATABASE ACCESSION NUMBER: NCBI ACCESSION: NZ_DS995298.1
  ref <309>: DATABASE ENTRY DATE: 2019-04-01
  ref <313>: RELEVANT RESIDUES IN SEQ ID NO: (1)..(1484)
ttaaacttgagagtttgatcatggctcagaacgtacgctggcggcacgcctaacacatgcaagtcgaacgaagtagcaatacttagtggcagacgggtgagtaacatgtaggtatctgccctttggcctggaataacacgaggaaacttgtgctaataccggataagtctttacggagaaagctttatgcaccattggatgagcctgcacttgattagtttgttggtggggtaatggcctaccaagactgtgatcaatagctgatttgagaggatgatcagccacattgggactgagacacggcccaaactcctacgggaggcagcagtggggaatcttgcacaatggaggaaactctgatgcagcgatgccgcgtgagtgaagaaggcccttgggttgtaaagctctttcgtcggggaagaaaatgactgtacccgaataagaaggtccggctaacttcgtgccagcagccgcggtaatacgaagggacctagcgtagttcggaattactgggcttaaagagttcgtaggtggttgaaaaagttagtggtgaaatcccagagcttaactctggaactgccattaaaacttttcagctagagtatgatagaggaaagcagaatttctagtgtagaggtgaaattcgtagatattagaaagaataccaattgcgaaggcagctttctggatcattactgacactgaggaacgaaagcatgggtagcgaagaggattagataccctcgtagtccatgccgtaaacgatgtgtgttagacgttggaaatttattttcagtgtcgcagggaaaccgataaacacaccgcctggggagtacgaccgcaaggttaaaactcaaatgaattgacggggacccgcacaagtagtggagcatgtggtttaattcgaagatacgcgcagaaccttaccaacacttgacatgttcgtcgcgactctaagagattagagttttcggttcggccggacgaaacacaggtgctgcatggctgtcgtcagctcgtgtcgtgagatgttgggttaagtcccgcaacgagcgcaaccctcacttttagttgccatcattaagttgggcactctgaaagaactgccagtgataagctggaggaaggtggggatgacgtcaagtcctcatggcccttacgtgttgggctacacacgtgctacaatggtatctacaacaggaagcgaaactgcgaagttaagcaaatccctaaaagatacctcagttcggattgcactctgcaactcgagtgcatgaagctggaattactagtaatcgtggatcagcgtgccacggtgaatgcgttcccgggtcttgtacacaccgcccgtcacaccatgggagttggttctaccttaaggcaaggttttaaacccttgaccacggtatagtcagcgactggggtgaagtcgtaacaaggtagccgtaggggaacctgcggctggattacctcctttctaagga

SEQ ID NO: 2469 - DNA, 1495 bp, Candidatus Pelagibacter sp. IMCC9063
  ref <308>: DATABASE ACCESSION NUMBER: NCBI ACCESSION: NC_015380.1
  ref <309>: DATABASE ENTRY DATE: 2019-04-01
  ref <313>: RELEVANT RESIDUES IN SEQ ID NO: (1)..(1495)
attaaacttgagagtttgatcatggctcagaacgtacgctggcggcacgcctaacacatgcaagtcgagcggggtagcaatacctagcggcagacgggtgcgtaacatgtgggaatctgccttttggttcggaacaacatggggaaacctgtgctaataccggataagtcctaacggagaaagttttaatgccaaaagatgagcccgcatttgattagcttgttggtgaggtaaaagctcaccaaggctataatcaatagctgatttgagaggatgatcagccacactgggactgagatacggcccagactcctacgggaggcagcagtggggaatcttgcacaatgggcgaaagcctgatgcagcgatgccgcgtgagtgaagaaggcctttgggttgtaaagctcttttgtcgggaaagataatgactgtacccgaagaataaggtccggctaacttcgtgccagcagccgcggtaatacgaagggacctagcgtagttcggaattactgggcgtaaagagtatgtaggcggctagataagttaattgtgaaagcccaaagcttaactttggaactgcaattaaaactatttagctagagtatgatagaggaaagcggaatacatagtgtagaggtgaaattcgtagatattatgtagaacaccagttgcgaaggcggctttctggatcattactgacgctgagatacgaaagtatgggtagcgaagaggattagataccctcgtagtccataccataaacgatgattattaaatgtggggaattatttctctgtattatagctaacgcgttaaataatccgcctggggagtacgaccgcaaggttaaaactcaaatgaattgacggggacccgcacaagcggtggagcatgtggtttaattcgaagcaacgcgcagaaccttaccaacccttgacatgtttgtcgcgaaactaagagattagtttcttcagttcggctggacaaaacacaggtgctgcatggctgtcgtcagctcgtgtcgtgagatgttgggttaagtcccgcaacgagcgcaacccctacttttagttgccatcaggttatgctgggcactctaatagaactgcctgtgataaacaggaggaaggtggggatgacgtcaagtcctcatggcccttacgggttgggctacacacgtgctacaatggtaggtacagtgagatgccgagcagcgatgcttagctaaactccaaaacctacctcagttcggattgcactctgcaactcgagtgcatgaagctggaatcgctagtaatcgtggatcagcgtgccacggtgaatacgttcccgggtcttgtacacaccgcccgtcacaccatggaaattggatttaccttaaggcaaattatgaaccctcgggacatgtttgaccacggtaagtttggtaactggggtgaagtcgtaacaaggtagccgtaggggaacctgcggctggattacctcctttctaagg

SEQ ID NO: 2470 - DNA, 1484 bp, Candidatus Pelagibacter sp. RS39
  ref <308>: DATABASE ACCESSION NUMBER: NCBI ACCESSION: NZ_CP020777.1
  ref <309>: DATABASE ENTRY DATE: 2019-04-01
  ref <313>: RELEVANT RESIDUES IN SEQ ID NO: (1)..(1484)
ttaaacttgagagtttgatcatggctcagaacgtacgctggcggcacgcctaacacatgcaagtcgaacgaagtagcaatacttagtggcagacgggtgagtaacatgtaggtatctaccctatggcctggaataacacgaggaaacttgtgctaatactggataagtctttacggagaaagctttatgcaccattggatgagcctgcacttgattagtttgttggtggggtaatggcctaccaagactttgatcaatagctgatttgagaggatgatcagccacattgggactgagacacggcccaaactcctacgggaggcagcagtggggaatcttgcacaatggaggaaactctgatgcagcgatgccgcgtgagtgaagaaggcctttgggttgtaaagctctttcgtcggggaagaaaatgactgtacccgaataagaaggtccggctaacttcgtgccagcagccgcggtaatacgaagggacctagcgtagttcggaattactgggcttaaagagttcgtaggtggttgaaaaagttggtggtgaaatcccagagcttaactctggaactgccatcaaaacttttcagctagagtatgatagaggaaagcagaatttctagtgtagaggtgaaattcgtagatattagaaagaataccaattgcgaaggcagctttctggatcattactgacactgaggaacgaaagcatgggtagcgaagaggattagataccctcgtagtccatgccgtaaacgatgtgtgttagacgttggaaatttattttcagtgtcgcagtgaaagcgataaacacaccgcctggggagtacgaccgcaaggttaaaactcaaatgaattgacggggacccgcacaagtagtggagcatgtggtttaattcgaagatacgcgcagaaccttaccaacacttgacatgttcgtcgcgactttaagagattaaagttttcggttcggccggacgaaacacaggtgctgcatggctgtcgtcagctcgtgtcgtgagatgttgggttaagtcccgcaacgagcgcaaccctcacttttagttgccatcattaagttgggcactctgaaagaactgccagtgataagctggaggaaggtggggatgacgtcaagtcctcatggcccttacgtgttgggctacacacgtgctacaatggtatatacaacaggaagcaaaacggcgacgttaagcaaatcctcaaaagatacctcagttcggattgcactctgcaactcgagtgcatgaagctggaattactagtaatcgtggatcagcgtgccacggtgaatgcgttcccgggtcttgtacacaccgcccgtcacaccatgggagttggttctaccttaaggcaaggtttcaaacccttgaccacggtatagtcagcgactggggtgaagtcgtaacaaggtagccgtaggggaacctgcggctggattacctcctttctaagga

SEQ ID NO: 2471 - DNA, 1484 bp, Candidatus Pelagibacter sp. RS40
  ref <308>: DATABASE ACCESSION NUMBER: NCBI ACCESSION: NZ_CP020778.1
  ref <309>: DATABASE ENTRY DATE: 2019-04-01
  ref <313>: RELEVANT RESIDUES IN SEQ ID NO: (1)..(1484)
ttaaacttgagagtttgatcatggctcagaacgtacgctggcggcacgccttatacatgcaagtcgaacgaagtagcaatacttagtggcagacgggtgagtaacatgtgggtatcttccctttggtgaggaataacacgaggaaacttgtgctaatacctcataagtctttacggagaaagctttatgcgccaatggatgagcccgcacttgattagtttgttggtggggtaatggcctaccaagactttgatcaatagctgatctgagaggatgatcagccacattgggactgagacacggcccaaactcctacgggaggcagcagtagggaatattgcacaatggaggaaactctgatgcagcgatgccgcgtgagtgaagaaggcctttgggttgtaaagctctttcgtcggggaagaaaatgacggtacccgaataagaaggtccggctaacttcgtgccagcagccgcggtaatacgaagggacctagcgtagttcggaattactgggcttaaagagttcgtaggtggttaaaaaagttggttgtgaaatcccgaagcttaacttcggaactgcaatcaaaactttttagctagagtatgatagaggaaagcagaatttctagtgtagaggtgaaattcgtagatattagaaagaataccaattgcgaaggcagctttctggatcattactgacgctgaggaacgaaagcatgggtagcgaagaggattagataccctcgtagtccatgccgtaaacgatgtgtgttagacgttggaaatttattttcagtgtcgcagcgaaagcagtaaacacaccgcctggggagtacgaccgcaaggttaaaactcaaatgaattgacggggacccgcacaagtagtggagcatgtggtttaattcgaagatacgcgcagaaccttaccaacacttgacatgttcgtcgcggctctaagagattagagctttcggttcggccggacgaaacacaggtgctgcatggctgtcgtcagctcgtgtcgtgagatgttgggttaagtcccgcaacgagcgcaaccctcacttttagttgccatcatttagttgggcactctgaaagaactgccagtgataagctggaggaaggtggggatgacgtcaagtcctcatggcccttacgtgttgggctacacacgtgctacaatggcatttacaataggaagcaagatggcgacgtcaagcaaaacctaaaaagatgcctcagttcggattgtactctgcaactcgagtacatgaagctggaattactagtaatcgcggatcagcgcgccgcggtgaatacgttcccgggtcttgtacacaccgcccgtcacaccatgggagttggttctaccttaaggcaaggcttaaaacccttgaccacggtatagtcagcgactggggtgaagtcgtaacaaggtagccgtaggggaacctgcggctggattacctcctttctaagga

SEQ ID NO: 2472 - DNA, 1474 bp, Candidatus Pelagibacter ubique
  ref <308>: DATABASE ACCESSION NUMBER: NCBI ACCESSION: NZ_CVST01000012.1
  ref <309>: DATABASE ENTRY DATE: 2019-04-01
  ref <313>: RELEVANT RESIDUES IN SEQ ID NO: (1)..(1474)
aacttgagagtttgatcatggctcagaacgtacgctggcggcacgcctaacacatgcaagtcgaacgaagtagcaatacttagtggcagacgggtgagtaacatgtaggtatctaccctttggcctggaataacacgaggaaacttgtgctaataccggataagtctttacggagaaagctttatgcaccattggatgagcctgcacttgattagtttgttggtggggtaatggcctaccaagactgtgatcaatagctgatttgagaggatgatcagccacattgggactgagacacggcccaaactcctacgggaggcagcagtggggaatcttgcacaatggaggaaactctgatgcagcgatgccgcgtgagtgaagaaggcccttgggttgtaaagctctttcgtcggggaagaaaatgactgtacccgaataagaaggtccggctaacttcgtgccagcagccgcggtaatacgaagggacctagcgtagttcggaattactgggcttaaagagttcgtaggtggttgaaaaagttagtggtgaaatcccagagcttaactctggaactgccattaaaacttttcagctagagtatgatagaggaaagcagaatttctagtgtagaggtgaaattcgtagatattagaaagaataccaattgcgaaggcagctttctggatcattactgacactgaggaacgaaagcatgggtagcgaagaggattagataccctcgtagtccatgccgtaaacgatgtgtgttagacgttggaaatttattttcagtgtcgcagcgaaagcgataaacacaccgcctggggagtacgaccgcaaggttaaaactcaaatgaattgacggggacccgcacaagtagtggagcatgtggtttaattcgaagatacgcgcagaaccttaccaacacttgacatgttcgtcgcgactctaagagattagagttttcggttcggccggacgaaacacaggtgctgcatggctgtcgtcagctcgtgtcgtgagatgttgggttaagtcccgcaacgagcgcaaccctcacttttagttgccatcatttagttgggcactctgaaagaactgccagtgataagctggaggaaggtggggatgacgtcaagtcctcatggcccttacgtgttgggctacacacgtgctacaatggtatctacaacaggaagcaagactgcgaggtcaagcaaatccttaaaagatacctcagttcggattgcactctgcaactcgagtgcatgaagctggaattactagtaatcgtggatcagcgtgccacggtgaatgcgttcccgggtcttgtacacaccgcccgtcacaccatgggagttggttctaccttaaggcaaggtttaaaacccttgaccacggtatagtcagcgactggggtgaagtcgtaacaaggtagccgtaggggaacctgcggctggattacctccttt

SEQ ID NO: 2473 - DNA, 1471 bp, Candidatus Phaeomarinobacter ectocarpi
  ref <308>: DATABASE ACCESSION NUMBER: NCBI ACCESSION: NZ_HG966617.1
  ref <309>: DATABASE ENTRY DATE: 2019-04-01
  ref <313>: RELEVANT RESIDUES IN SEQ ID NO: (1)..(1471)
aacttgagagtttgatcctggctcagaacgaacgctggcggcaggcctaacacatgcaagtcgaacgccctcttcggagggagtggcagacgggtgagtaacgcgtgggaacctacccaagggtacgggacaactcagggaaacttgagctaataccgtatacgtccttagggagaaagatttatcgcccctggatgggcccgcgttggattagctagttggtggggtaatggcctaccaaggcgacgatccatagctggtctgagaggatgatcagccacactggaactgagacacggtccagactcctacgggaggcagcagtggggaatattggacaatgggcgcaagcctgatccagccatgccgcgtgagtgatgaaggccctagggttgtaaaactctttcagtggtgaagataatgacggtaaccacagaagaagctccggctaactccgtgccagcagccgcggtaatacggagggagctagcgttgttcggaattactgggcgtaaagcgcacgtaggcggtctataaagttgggggtgaaatcccggagctcaactccggaactgcctccaaaactgctagactcgagttcggaagaggtaagtagaattcccagtgtagaggtgaaattcgtagatattgggaagaataccagtggcgaaggcggcttactggtccgatactgacgctgaggtgcgaaagcgtggggagcaaacaggattagataccctggtagtccacgccgtaaacgatgagagctagttgtcaggcagtatactgtttggtgacgcagctaacgcattaagctctccgcctggggagtacggtcgcaagattaaaactcaaaggaattgacgggggcccgcacaagcggtggagcatgtggtttaattcgaagcaacgcgcagaaccttaccagctcttgacataccaatcgcgattagtggagacacttttcttcagttcggctggattggatacaggtgctgcatggctgtcgtcagctcgtgtcgtgagatgttgggttaagtcccgcaacgagcgcaaccctcgcccttagttgccagcatttagttgggcactctaagggaactgccggtgataagccggaggaaggtggggatgacgtcaagtcctcatggcccttatgggctgggctacacacgtgctacaatggcggtgacagtgggacaatccccaaaaaccgtctcagttcggattgcactctgcaactcgagtgcatgaagttggaatcgctagtaatcgtggatcagcatgccacggtgaatacgttcccgggccttgtacacaccgcccgtcacaccatgggagttggctttacccgaaggtggtgcgctaacctagcaataggaagcagccaaccacggtaaggtcagcgactggggtgaagtcgtaacaaggtagccgtaggggaacctgcggctggatcacctcctttcta

SEQ ID NO: 2474 - DNA, 1504 bp, Candidatus Phycorickettsia trachydisci
  ref <308>: DATABASE ACCESSION NUMBER: NCBI ACCESSION: NZ_CP027845.1
  ref <309>: DATABASE ENTRY DATE: 2019-04-01
  ref <313>: RELEVANT RESIDUES IN SEQ ID NO: (1)..(1504)
tcaaatttgagagtttgatcctggctcagaacgaacgctggcggcacgcctaacacatgcaagtcgaacggacattttttggagcttgctctaagaaatgttagtggcaaacgggtgagtaacacgtgggaatctgcccattagtacggaataacccttggaaacaagagctaatactgtatattctcgaaagaggaaagatttatcgctaatggatgagcccgcgccggattaggtagttggtggggtaatagcctaccaagccaatgatctgtagctggtctgagaggtcggacagccacactgggactgagacacggcccagactcctacgggaggcagcagtggggaatattgggcaatgggcgcaagcctgacccagcgatgccgcgtgaatgatgaaggccttcgggttgtaaagttcttttagtagggaagataatgacggtacctacagaaaaagcaccggctaacttcgtgccagcagccgcggtaatacgaagggtgctagcgttgttcggaattactgggcgtaaaacgcgtgcaggtggtctagtaagttgaaagtaaaatcccagggcttaaccttggaactgctttcaaaactgttaggctagagtgcggtagaggatgatagaattcctagtgtagaggtgaaattcttagatattaggaggaataccgatggcgaaggcaatcatctgggccgttactgacactaatacgcgaaagcgtggggagcaaacaggattagataccctggtagtccacgctgtaaacgatgaatgttagatgtcggggagattactcctcggtttcgtagctaacgcgttaaacattctgcctggggagtacgatcgcaagattaaaactcaaaggaattgacgggggcccgcacaagcggtggagcatgcggtttaattcgatgctacgcgaaaaaccttaccaacccttgacatggtggtcgtagctaaaggagactttagcgtcagctcggctggaccacacacaggtgctgcatggctgtcgtcagctcgtgtcgtgagatgttgggttaagtcccgcaacgagcgcaacccttatccttatttgccagcgagtaatgtcgggaactataaggaaactgccggtgataaaccggaggaagatgaggacgacgtcaagtcatcatggcccttacgggttgggctacacgcgtgctacaatggtatctacaatggggcgcaatactgtaaggtggagcaaatccataaaagatacctcagttcggattgagctctgcaactcgagctcatgaagtcggaatcgctagtaatcgcggatcagcatgccgcggtgaatacgttcccgggccttgtacacactgcccgtcacaccatgggagttgattttactttaagctggtaagctaacgcgcaagcggggcagctagccacagtaaggttagcgactggggtgaagtcgtaacaaggtagccgtaggggaacctgcggctggattacct

SEQ ID NO: 2475 - DNA, 1471 bp, Candidatus Phycosocius bacilliformis
  ref <308>: DATABASE ACCESSION NUMBER: NCBI ACCESSION: NZ_BFBR01000005.1
  ref <309>: DATABASE ENTRY DATE: 2019-04-01
  ref <313>: RELEVANT RESIDUES IN SEQ ID NO: (1)..(1471)
caatctgagagtttgatcctggctcagagcgaacgctggcggcaggcttaacacatgcaagtcgaacgccatcttcggatggagtggcagacgggtgagtaacgcgtgggaacgtaccctttggttcggaatattctcgggaaactgagagcaataccggataagccctacgggggaaagatttatcgccaaaggagcggcccgcgtcagattaggtagttggtggggtaaaggcctaccaagcctacgatctgtagctggtctgagaggatgatcagccacactgggactgagacacggcccagactcctacgggaggcagcagtggggaatattggacaatgggcgcaagcctgatccagccatgccgcgtggatgatgaaggccttagggttgtaaaatcctttcaacggggacgataatgacggtacccgtagaagaagccccggctaacttcgtgccagcagccgcggtaatacgaagggggctagcgttgctcggaattactgggcgtaaagcgcacgtaggcggatatttaagtcggaggtgaaagcccagggctcaaccctggaactgccctcgatactgggtatctggaccaaagtagaggtaagtggaattccgagtgtagaggtgaaattcgtagatattcggaggaacaccagtggcgaaggcgacttactggacttttggtgacgctgaggtgcgaaagcgtggggagcaaacaggattagataccctggtagtccacgccgtaaacgatgaatgctagttgtcagcacgcatgcgtgttggtgacgcagctaacgcattaagcattccgcctggggagtacggccgcaaggttaaaactcaaaggaattgacgggggcccgcacaagcggtggagcatgtggtttaattcgaagcaacgcgcagaaccttacctacgcttgacatgtctcggaacaggaccagagatggacctggacggttcggccgccgagaacacaggtgctgcatggctgtcgtcagctcgtgtcgtgagatgttgggttaagtcccgcaacgagcgcaaccctcgctactagttgccagcacgtctgggtgggcactctagtggaactgccggtggcaagccggaggaaggtggggatgacgtcaagtcctcatggcccttacgcgtagggctacacacgtgctacaatggtggtgacagagggttaatccctaaaagccatctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggctgtgcgccaaccgcaagggggcagcagaccacggtgggatcagcgactggggtgaagtcgtaacaaggtagccgtaggggaacctgcggctggatcacctcctttctaa

SEQ ID NO: 2476 - DNA, 1519 bp, Candidatus Planktophila dulcis
  ref <308>: DATABASE ACCESSION NUMBER: NCBI ACCESSION: NZ_CP016777.1
  ref <309>: DATABASE ENTRY DATE: 2019-04-01
  ref <313>: RELEVANT RESIDUES IN SEQ ID NO: (1)..(1519)
tatggagagtttgatcctggctcaggacgaacgctggcggcgtgcttaacacatgcaagtcgagcgatgaaacaccttcgggtgtgaattagcggcgaacgggtgaggaacacgtgaagaatctgccttcaactctgggataactccgggaaaccggggctaataccggatatgagccttgatcgcatgatcggggctggaaagtttttcggttgaagatgacttcgcggcctatcagcttgttggtgaggtaatggctcaccaaggcgacgacgggtagccggcctgagagggcgaccggccacactgggactgagacacggcccagactcctacgggaggcagcagtggggaatattgggcaatggaggaaactctgacccagcgacgccgcgtgagggatgaaggccttcgggttgtaaacctctttcagtagggaagaagcgaaagtgacggtacctacagaagaagcaccggctaactatgtgccagcagccgcggtaatacatagggtgcaagcgttgtccggaattattgggcgtaaagagctcgtaggtggttcgatacgtcggatgtgaaaatcaggggctcaacccctgacctgcatccgatacggtcgagctggagtttggtaggggagactggaattcctggtgtagcggtggaatgcgcagatatcaggaggaacaccgatggcgaaggcaggtctctgggccaatactgacactgaggagcgaaagcgtggggagcgaacaggattagataccctggtagtccacgccgtaaacggtgggcgctagttgtgcgaaccttccacggtttgtgcgacgcagctaacgcattaagcgccccgcctggggagtacgatcgcaagattaaaactcaaaggaattgacggggccccgcacaagcagcggagcatgcggcttaattcgacgcaacgcgaagaaccttaccaaggcttgacatatacaggaatatggcagagatgtcatagccgcaaggtctgtatacaggtggtgcatggttgtcgtcagctcgtgtcgtgagatgttgggttaagtcccgcaacgagcgcaaccctcgttctgtgttgccagcattaagttggggactcacaggagactgccggggttaactcggaggaaggtggggatgacgtcaaatcatcatgccccttatgtcttgggctgcacgcatgctacaatggctggtacaaacggctgcgataccgcaaggtggagcgaatccgataaagccagtctcagttcggattggggtctgcaactcgaccccatgaagtcggagttgctagtaatcgtagatcagcaacgctacggtgaatacgttcccggggcttgtacacaccgcccgtcacatcacgaaagtcggtaacacccaaagtcagtggcccaaccgtaaggagggagctgccaaaggtgggatcggtgattgggatgaagtcgtaacaaggtagccgtaccggaaggtgcggctggatcacctcctttctaaggag

SEQ ID NO: 2477 - DNA, 1519 bp, Candidatus Planktophila versatilis
  ref <308>: DATABASE ACCESSION NUMBER: NCBI ACCESSION: NZ_CP016781.1
  ref <309>: DATABASE ENTRY DATE: 2019-04-01
  ref <313>: RELEVANT RESIDUES IN SEQ ID NO: (1)..(1519)
tatggagagtttgatcctggctcaggacgaacgctggcggcgtgcttaacacatgcaagtcgagcgatgaaacaccttcgggtgtgaattagcggcgaacgggtgaggaacacgtgaagaatctgccttcaactctgggataactccgggaaaccggggctaataccggatatgagccttgatcgcatgatcggggctggaaagtttttcggttgaagatgacttcgcggcctatcagcttgttggtgaggtaatggctcaccaaggcgacgacgggtagccggcctgagagggcgaccggccacactgggactgagacacggcccagactcctacgggaggcagcagtggggaatattgggcaatggaggaaactctgacccagcgacgccgcgtgagggatgaaggccttcgggttgtaaacctctttcagtagggaagaagcgaaagtgacggtacctacagaagaagcaccggctaactatgtgccagcagccgcggtaatacatagggtgcaagcgttgtccggaattattgggcgtaaagagctcgtaggtggttcgatacgtcggatgtgaaaatcaggggctcaacccctgacctgcatccgatacggtcgagctggagtttggtaggggagactggaattcctggtgtagcggtggaatgcgcagatatcaggaggaacaccgatggcgaaggcaggtctctgggccaatactgacactgaggagcgaaagcgtggggagcgaacaggattagataccctggtagtccacgccgtaaacggtgggcgctagttgtgcgaaccttccacggtttgtgcgacgcagctaacgcattaagcgccccgcctggggagtacgatcgcaagattaaaactcaaaggaattgacggggccccgcacaagcagcggagcatgcggcttaattcgacgcaacgcgaagaaccttaccaaggcttgacatatacaggaatacggcagagatgtcgtagccgcaaggtctgtatacaggtggtgcatggttgtcgtcagctcgtgtcgtgagatgttgggttaagtcccgcaacgagcgcaaccctcgttctgtgttgccagcatttagttggggactcacaggagactgccggggttaactcggaggaaggtggggatgacgtcaaatcatcatgccccttatgtcttgggctgcacgcatgctacaatggctggtacaaacggctgcgataccgcaaggtggagcgaatccgataaagccagtctcagttcggattggggtctgcaactcgaccccatgaagtcggagttgctagtaatcgtagatcagcaacgctacggtgaatacgttcccggggcttgtacacaccgcccgtcacatcacgaaagtcggtaacacccaaagtcagtggcccaaccgtaaggagggagctgccaaaggtgggatcggtgattgggatgaagtcgtaacaaggtagccgtaccggaaggtgcggctggatcacctcctttctaaggag

SEQ ID NO: 2478 - DNA, 1507 bp, Candidatus Promineofilum breve
  ref <308>: DATABASE ACCESSION NUMBER: NCBI ACCESSION: NZ_LN890655.1
  ref <309>: DATABASE ENTRY DATE: 2019-04-01
  ref <313>: RELEVANT RESIDUES IN SEQ ID NO: (1)..(1507)
tttatggagagtttgatcctggctcaggatgaacgctagcggtgtgcttaaagcatgcaagtcgaacgtgatcccttggattcgtctgagggtgaaagtggcgaacgggtgagtaacgcgttggtgatctgccccggagtggggaataactattggaaacgatagctaataccccagatgtcctcgtttttggaaagcgatgactgaagttcaggcgctccgggaggagccagcgtcccatcagctagttggtaaggtaatggcttaccaaggcacagacgggtagggggcgtgagagcgtgaccccccacactggtactgacacacggaccagatacctacgggtagcagcagctaggaatattggacaatgggcgaaagcctgatccagcaacaccgcgtggaggacgaaggccttcgggtcgtaaactcctttttggggggatgagaaaggacagtacccccagaataaggcccggctaactacgtgccagcagccgcggtaatacgtaggggccaagcgttatccggatttactgggcgtaaagcgcatgtaggcggtttattaagtcggacgtgaaagctcctggctcaactgggagaggtcgttcgaaactagtagactggaggatggtagaggagagcggaattcccggtgtagcggtgaaatgcgtagatatcgggaggaacaccagtggcgaaagcggctctctggcccattcctgacgctgagatgcgaaagccaggggagagaacgggattagaaaccccggtattcctggccgtaaacgatgtcaactaggcgtaggaggttattgaccccttctgtgctgtagctaacgcgttaagttgaccgcctggggactacggccgcaaggctaaaactcaaaggaattgacgggtccccgcacaagcagcggagcgtgtggtttaattcgaggctacgcgaagaaccttaccagggtttgacatgctagtggtagtgaagcgaaagcggaacgacccttcggggagctagcacaggtgctgcatggctgtcgtcagctcgtgtcgtgagatgtcaggttaagtcctgtaacgagcgcaaccctcgtcgctagttatacgtgtctagcgagactgcccgtgataaacgggaggaaggtgaggatgatgtcaagtcagcatggcctttatatcctgggctacacacacgctacaatggccagtacaatgggttgccaagtcgcgagacggagccaatcccgtaaagctggtctcagttcggattgcaggctgcaactcgcctgcatgaagtcggagttgctagtaaccgcgcgtcagcacagtgcggtgaatacgttcccggggattgtacacaccgcccgtcacgtcatggaagttggcaacgcctgaagtcggtgagctaacccgcaagggaggcagccgcccaaggcggggtcggtaactgggacgaagtcgtaacaaggtagccgtaccggaaggtgcggctggatcacctcctttt

SEQ ID NO: 2479 - DNA, 1545 bp, Candidatus Protochlamydia amoebophila
  ref <308>: DATABASE ACCESSION NUMBER: NCBI ACCESSION: NZ_JSAN01000164.1
  ref <309>: DATABASE ENTRY DATE: 2019-04-01
  ref <313>: RELEVANT RESIDUES IN SEQ ID NO: (1)..(1545)
ttttctgtgagaatttgatcttggttcagattgaatgctgacagcgtggatgaggcatgcaagtcgaacgaaaccttcgggtttagtggcggaagggttagtaagacatggataacttgcctttaactctgggataacggttggaaacgaccgctaataccggatagggtgaagagaagacatctttttttcattaaagtgggggatcgcaagacctcgcggttaaagagaggtccatgggatatcagctagttggtgtggtaaaggcgcaccaaggctaagacgtctaggcggattgagagattgaccgccaacactgggactgagaactgcccagactcctacgggaggctgcagtcgagaatcattcgcaatgggcgaaagcctgacgatgcgacgctgtgtgagtgaagaaggccttagggtcgtaaagctctttcgcctgagaacaagatgagctggctaacatccagtgattttgagcgtaccaggtaaagaagcaccggctaactccgtgccagcagctgcggtaatacggagggtgcaagcattaatcggatttattgggcgtaaagggcgcgtaggcgggggtgtcagtcagatgtgaaatcccggggctcaacctcggaacagcatttgaaactacatctctagagggtaggcggagaaaacggaattccacaagtagcggtgaaatgcgtagatatgtggaagaacaccggtggcgaaggcggttttctagcttatacctgacgctaaagcgcgaaagcaaggggatcaaacaggattagataccctggtagtccttgccgtaaactatgtatacttggtgtaactggactcaaccctagttgtgccgtagctaacgcgttaagtataccgcctggggagtacagtcgcaaggctgaaactcaaaagaattgacggggacccgcacaagcagtggagcatgtggtttaattcgatgcaacgcgaagaaccttacccagacttgacatgtagtagaccggtctagaaataggcctttccttcgggactgctacacaggtgctgcatggctgtcgtcagctcgtgccgtgaggtgttgggttaagtcccgcaacgagcgcaacccttatcattagttgccaacatttaaggtgggaactctaatgagactgcctgggttaaccaggaggaaggtgaggatgacgtcaagtccgcatggcccttatgtctggggctacacacgtgctacaatggtcggtacaaaaggcagcgaagccgcgaggtgaagcaaatcccgaaagccggccccagttcagattgtagtctgcaactcgactacatgaagacggaattgctagtaatggcgagtcagcaacatcgccgtgaatacgttcccgggtcttgtacacaccgcccgtcacatcatgggagttggttttacccgaatccgctggcttaaccgcaagggaagaggcgtgtaaggtgaggccgatgactgggatgaagtcgtaacaaggtagccctaccggaaggtggggctggatcacctcctttaaa

SEQ ID NO: 2480 - DNA, 1545 bp, Candidatus Protochlamydia naegleriophila
  ref <308>: DATABASE ACCESSION NUMBER: NCBI ACCESSION: NZ_LN879502.1
  ref <309>: DATABASE ENTRY DATE: 2019-04-01
  ref <313>: RELEVANT RESIDUES IN SEQ ID NO: (1)..(1545)
ttttctgtgagaatttgatcttggttcagattgaatgctgacggcgtggatgaggcatgcaagtcgaacggaaccttcgggttcagtggcggaagggttagtaatacatgggtaacctgcctttaactctgggataacggttggaaacgaccgctaataccagatacagtgagaataagacatctttttcttattaaagtgggggatcgtaagacctcgcggttaaagaggggcccatgcgatatcagctagttggtgtggtaaaggcgcaccaaggctaagacgtctaggcggattgagagattgaccgccaacactgggactgagaactgcccagactcctacgggaggctgcagtcgagaatcattcgcaatgggcgaaagcctgacgatgcgacgccgtgtgagcgaagaaggccttagggtcgtaaagctctttcgcttgggaataagataaactggctaatatccagtaagtttgaacgtaccaggtaaagaagcaccggctaactccgtgccagcagctgcggtaatacggagggtgcaagcattaatcggatttattgggcgtaaagggcgcgtaggcggggatgtaagtcagacgtgaaatcccggggctcaacctcggaacagcatttgaaactacatctctcgagggtaggcggagaaaacggaattccacaagtagcggtgaaatgcgtagatatgtggaagaacaccggtggcgaaggcggttttctagcttattcctgacgctaaagcgcgaaagcaaggggatcaaacaggattagataccctggtagtccttgccgtaaactatgtatacttggtgtaactggactcaaccctagttgtgccgtagctaacgcgttaagtataccgcctggggagtacagtcgcaaggctgaaactcaaaagaattgacggggacccgcacaagcagtggagcatgtggtttaattcgatgcaacgcgaagaaccttacccagacttgacatgcagtagaccggtctagaaataggcctttccttcgggactgctgcacaggtgctgcatggctgtcgtcagctcgtgccgtgaggtgttgggttaagtcccgcaacgagcgcaacccttatcattagttgccaacatttaaggtgggaactctaatgagactgcctgggttaaccaggaggaaggtgaggatgacgtcaagtccgcatggcccttatgtctggggctacacacgtgctacaatggtcggtacaaaaggcagcgaaaccgcgaggtgaagcaaatcccgaaagccggccccagttcagattgtagtctgcaactcgactacatgaagacggaattgctagtaatggcgagtcagcaacatcgccgtgaatacgttcccgggtcttgtacacaccgcccgtcacatcatgggagttggttttacccgaatccgctggcttaaccgcaaggaaagaggcgtgtaaggtaaggccgatgactgggatgaagtcgtaacaaggtagccctaccggaaggtggggctggatcacctcctttaaa

SEQ ID NO: 2481 - DNA, 1545 bp, Candidatus Protochlamydia sp. R18
  ref <308>: DATABASE ACCESSION NUMBER: NCBI ACCESSION: NZ_BASL01000720.1
  ref <309>: DATABASE ENTRY DATE: 2019-04-01
  ref <313>: RELEVANT RESIDUES IN SEQ ID NO: (1)..(1545)
ttttctgtgagaatttgatcttggttcagattgaatgctgacagcgtggatgaggcatgcaagtcgaacgaaaccttcgggtttagtggcggaagggttagtaagacatggataacttgcctttaactctgggataacggttggaaacgaccgctaataccggatagggtgaaaagaagacatcttttttttattaaagtgggggatcgcaagacctcgcggttaaagagaggtccatgggatatcagctagttggtgtggtaaaggcgcaccaaggctaagacgtctaggcggattgagagattgaccgccaacactgggactgagaactgcccagactcctacgggaggctgcagtcgagaatcattcgcaatgggcgaaagcctgacgatgcgacgctgtgtgagtgaagaaggccttagggtcgtaaagctctttcgcctgagaacaagatgagctggctaacatccagtgattttgagcgtaccaggtaaagaagcaccggctaactccgtgccagcagctgcggtaatacggagggtgcaagcattaatcggatttattgggcgtaaagggcgcgtaggcgggggtgtcagtcagatgtgaaatcccggggctcaacctcggaacagcatttgaaactacatctctagagggtaggcggagaaaacggaattccacaagtagcggtgaaatgcgtagatatgtggaagaacaccggtggcgaaggcggttttctagcttatacctgacgctaaagcgcgaaagcaaggggatcaaacaggattagataccctggtagtccttgccgtaaactatgtatacttggtgtaactggactcaaccctagttgtgccgtagctaacgcgttaagtataccgcctggggagtacagtcgcaaggctgaaactcaaaagaattgacggggacccgcacaagcagtggagcatgtggtttaattcgatgcaacgcgaagaaccttacccagacttgacatgtagtagaccggtctagaaataggcctttccttcgggactgctacacaggtgctgcatggctgtcgtcagctcgtgccgtgaggtgttgggttaagtcccgcaacgagcgcaacccttatcattagttgccaacatttaaggtgggaactctaatgagactgcctgggttaaccaggaggaaggtgaggatgacgtcaagtccgcatggcccttatgtctggggctacacacgtgctacaatggtcggtacaaaaggcagcgaagccgcgaggtgaagcaaatcccgaaagccggccccagttcagattgtagtctgcaactcgactacatgaagacggaattgctagtaatggcgagtcagcaacatcgccgtgaatacgttcccgggtcttgtacacaccgcccgtcacatcatgggagttggttttacccgaatccgctggcttaaccgcaagggaagaggcgtgtaaggtgaggccgatgactgggatgaagtcgtaacaaggtagccctaccggaaggtggggctggatcacctcctttaaa

SEQ ID NO: 2482 - DNA, 1368 bp, Candidatus Protochlamydia sp. W-9
  ref <308>: DATABASE ACCESSION NUMBER: NCBI ACCESSION: NZ_BCPZ01000131.1
  ref <309>: DATABASE ENTRY DATE: 2019-04-01
  ref <313>: RELEVANT RESIDUES IN SEQ ID NO: (1)..(1368)
agacatcttttttttattaaagtgggggatcgcaagacctcgcggttaaagagaggtccatgggatatcagctagttggtgtggtaaaggcgcaccaaggctaagacgtctaggcggattgagagattgaccgccaacactgggactgagaactgcccagactcctacgggaggctgcagtcgagaatcattcgcaatgggcgaaagcctgacgatgcgacgctgtgtgagtgaagaaggccttagggtcgtaaagctctttcgcctgggaacaagatgagctggctaacatccagtgattttgagcgtaccaggtaaagaagcaccggctaactccgtgccagcagctgcggtaatacggagggtgcaagcattaatcggatttattgggcgtaaagggcgcgtaggcgggggtgtcagtcagatgtgaaatcccggggctcaacctcggaacagcatttgaaactacatctctagagggtaggcggagaaaacggaattccacaagtagcggtgaaatgcgtagatatgtggaagaacaccggtggcgaaggcggttttctagcttatacctgacgctaaagcgcgaaagcaaggggatcaaacaggattagataccctggtagtccttgccgtaaactatgtatacttggtgtaactggactcaaccctagttgtgccgtagctaacgcgttaagtataccgcctggggagtacagtcgcaaggctgaaactcaaaagaattgacggggacccgcacaagcagtggagcatgtggtttaattcgatgcaacgcgaagaaccttacccagacttgacatgtagtagaccggtctagaaataggcctttccttcgggactgctacacaggtgctgcatggctgtcgtcagctcgtgccgtgaggtgttgggttaagtcccgcaacgagcgcaacccttatcattagttgccaacatttaaggtgggaactctaatgagactgcctgggttaaccaggaggaaggtgaggatgacgtcaagtccgcatggcccttatgtctggggctacacacgtgctacaatggtcggtacaaaaggcagcgaagccgcgaggtgaagcaaatcccgaaagccggccccagttcagattgtagtctgcaactcgactacatgaagacggaattgctagtaatggcgagtcagcaacatcgccgtgaatacgttcccgggtcttgtacacaccgcccgtcacatcatgggagttggttttacccgaatccgctggcttaaccgcaagggaagaggcgtgtaaggtgaggccgatgactgggatgaagtcgtaacaaggtagccctaccggaaggtggggctggatcacctcctttaaa

SEQ ID NO: 2483 - DNA, 1538 bp, Candidatus Pseudomonas adelgestsugas
  ref <308>: DATABASE ACCESSION NUMBER: NCBI ACCESSION: NZ_CP026512.1
  ref <309>: DATABASE ENTRY DATE: 2019-04-01
  ref <313>: RELEVANT RESIDUES IN SEQ ID NO: (1)..(1538)
aactaaagagtttgatcatggctcagattgaacgctggcggcaggcctaacacatgcaagtcgagcggtagagagaagcttgcttctctcaagagcggcggacgggtgagtaatgcctaggaatctgcctggtagcgggggataacgttcggaaacaaacgctaataccgcatacgtcctacgggagaaagcaggggaccctcaaggccttgcactatcagatgagcctaggtcggattagctagtcggtgaggtaatagctcaccgaggcaacgatccgtaactggtctgagaggatgatcagtcacactggaactgagacacggtccagactcctacgggaggcagcagtggggaatattggacaatgggcaaaagcctgatccagccatgccgcgtgtgtgaagaaggtcttcggattgtaaagcactttaagttgggaagaagagcacttacctaatatgtaagtgttttgacgttaccaacaaaataagcaccggctaactctgtgccagcagccgcggtaatacagagggtgcaagcgttaatcggaattactgggcgtaaagcgcgcgtaggtggccagttaagttggatgtgaaatctcttggctcaacctggaaactgcattcaaaactgactgactagagtatggtagagggtggtggaatttcctgtgtagcggtgaaatgcgtagatataggaaggaacaccagtggcgaaggcgaccacctggactgatactgacactgaggtgcaaaagcgtggggagcaaacaggattagataccctggtagtccacgccgtaaacgatgtcaactagccgttagaagccttgagtttctagtgacgtagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaattttctagagataggaaagtgccttcgggagcattgagacaggtgctgcatggctgtcgtcagctcgtgtcgtgagatgttgggttaagtcccgtaacgagcgcaacccttatctttagttaccagcacatcatggtgggcactctaaagagactgccggtgacaagccggaggaaggtggggatgacgtcaagtcatcatggcccttacggcctgggctacacacgtgctacaatggtcggcacaaagggttgccaaatcgcgaggtggagctaatcccacaaaaccgatcgtagttcggatcgcagtctgcaactcgactgcgtgaagtcggaatcgctagtaatcgcgaatcagaatgtcgcggtgaatacgttcccgggccttgtacacaccgcccgtcacaccatgggagtgggttgtaccagaagtggctagtttaacctccgggagaacggttaccacggtgtgattcatgactggggtgaagtcgtaacaaggtagccgtaggggaacctgcggctggatcacctccttaa

SEQ ID NO: 2484 - DNA, 1499 bp, Candidatus Puniceispirillum marinum
  ref <308>: DATABASE ACCESSION NUMBER: NCBI ACCESSION: NC_014010.1
  ref <309>: DATABASE ENTRY DATE: 2019-04-01
  ref <313>: RELEVANT RESIDUES IN SEQ ID NO: (1)..(1499)
taacctaagagtttgatcctggctcagaacgaacgctggcggcatgcctaacacatgcaagtcgaacgctatctttgatagagtggcgcacgggtgagtaacgcgtgggaacctgcctttcactgcgggacaacgattggaaacgatcgctaataccgcatacgccctacgggggaaagatttatcggtgatagaggggcccgcgtctgattagcttgttggtagggtaatggcctaccaaggcgacgatcggtagctggtctgagaggatgatcagccacactgggactgagacacggcccagactcctacgggaggcagcagtggggaatattggacaatgggggcaaccctgatccagcaatgccgcgtgtgtgatgaaggccttagggttgtaaagcactttcactggtgaagatgatgacggtaaccagagaagaagccccggctaacttcgtgccagcagccgcggtaatacgaagggggcgagcgttgttcggaattactgggcgtaaagggcgcgtaggcggtcttttaagttaggcgtgaaagccccgggctcaacctgggaactgcgcttaaaactggaagactagaaaacggaagagggtagtggaattcccagtgtagaggtgaaattcgtagatattgggaagaacaccagtggcgaaagcggctacctggtccgattttgacgctgaggcgcgaaagcgtggggagcaaacaggattagataccctggtagtccacgccgtaaacgatgtctgctagatgtcggggggttgcccctcggtgtcgccgctaacgcattaagcagaccgcctgggaagtacggtcgcaagattaaaactcaaaggaattgacgggggcccgcacaagcggtggagcatgtggtttaattcgaagcaacgcgcagaaccttaccagtccttgacatgggtagtttggtttccggagacggattccttcagttcggctggctaccacacaggtgctgcatggctgtcgtcagctcgtgtcgtgagatgttgggttaagtcccgcaacgagcgcaaccctcatctttagttgccagcggttaggccgggcactctagagaaactgcctgcgatgagcaggaggaaggcggggatgacgtcaagtcctcatggcccttatggactgggctacacacgtgctacaatggcggtgacaacgggcagcgaaggggtgacctggagcaaatcccaaaaaaccgtcccagttcggattgtactctgcaactcgagtacatgaagttggaatcgctagtaatcgcggatcagcatgccgcggtgaatacgttcccgggccttgtacacaccgcccgtcacaccatgggaattggttctacccgaatgcggtgagctaacctgcttgcaggaggcagccgaccacggtagggtcagtgactggggtgaagtcgtaacaaggtagccgtaggggaacctgcggctggatcacctcctttctaaggaaaa

SEQ ID NO: 2485 - DNA, 1469 bp, Candidatus Rhodobacter lobularis
  ref <308>: DATABASE ACCESSION NUMBER: NCBI ACCESSION: NZ_LFTY01000001.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgagcgaaccttcgggttagcggcggacgggtgagtaacgcgtgggaatatgccctttggtacggaatagcctctggaaacggagagtaataccgtatgtgcccttcgggggaaagatttatcgccaaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagtgacgaaggccctagggtcgtaaagctctttcgccagggaagataatgacggtacctggtaaagaaaccccggctaactccgtgccagcagccgcggtaatacggagggggttagcgttgttcggaattactgggcgtaaagcgcacgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggtagcatgctattcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacttatcgcggtttccagagatggattccttcagttcggctggatgagatacaggtgctgcatggctgtcgtcagctcgtgtcgtgagatgttcggttaagtccggcaacgagcgcaacccacgtccttagttaccagcattcagttgggtaccctagggagactgccggtgataagccggaggaaggtgtggatgacgtcaagtcctcatggcccttacgggttgggctacacacgtgctacaatggcattgacaatgggttaatcccaaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctttcgagggggcagctggccacggtaggttcagcgactggggtgaagtcgtaacaaggtagccgtaggggaacctgcggctggatcacctcctttctaa

SEQ ID NO: 2486 - DNA, 1642 bp, Candidatus Rickettsiella viridis
  ref <308>: DATABASE ACCESSION NUMBER: NCBI ACCESSION: NZ_AP018005.1
  ref <309>: DATABASE ENTRY DATE: 2019-04-01
  ref <313>: RELEVANT RESIDUES IN SEQ ID NO: (1)..(1642)
gaagtgaagagtttgattctggctcagattgaacgctggcggtatgcctaacacatgcaagtcgaacggcagcatgtcccgcacttaactcagattgcctgaattattttggtatttttcacgtttgtgtgaaaaactgaaaatgagagaggggtataagaatctaagttaagtgcgggatgatggcgagtggcggacgggtgagtaataggtaggaatctgtcctggagagtgggataacacgcggaaacgcgtgctaataccgcataatattgagaaatcaaagcaggggacccttcggggccttgcgctctaggttgagcctacgtcggattagctagttggtggggtaaaggcctaccaaggcgacgatccgtagctggtctgagaggatgaccagccacactgggactgagacacggcccagactcctacgggaggcagcagtggggaatcttggacaatgggggaaaccctgatccagcgataccgcgtgtgtgaagaaggccttcgggttgtaaagcactttaggtgggaaagaaaggtaatcgaggaatattcgattactgtgacggtacccacagaataagcaccggctaactctgtgccagcagccgcggtaatacagagggtgcaagcgttaatcagaatgactgggcgtaaagggcgtgtaggtggttgactaggtttgatgtgaaatccccgggcttaacctgggaatggcgtcgaaaacgggttgactagagtgagagagagggttgtggaatttccggtgtagcggtgaaatgcgtagatatcggaaagaacatcagtggcgaaggcgacaacctggctcttaactgacactgaggcgcgaaggcgtggggagcaaacaggattagataccctggtagtccacgcggtaaacgatgagaactggctgtgaggcgtgggacttcggttctgcgcgacgtagcgaagctaacgcgttaagttctccgcctggggagtacggccgcaaggttaaaactcaaagaaattgacgggggcccgcacaagcggtggagcatgtggtttaattcgatgcaacccgaagaaccttacctacccttgacatccttagtattgagcagagatgctcgagtgccgaaaggaactaagagacaggtgctgcatggctgtcgtcagctcgtgtcgtgagatgttgggttaagtcccgtaacgagcgcaacccttatcctttattgccaacaggtaaagctgggaacttaaaggagactgccggtgataaaccggaggaaggtggggaccacgtcaagtcatcatggcctttatgggtagggctacacacgtgctacaatggagcgtacagaaggaagccaacccgcgagggggagccaatcctgtaaaacgtttcgtagtccggattggagtctgcaactcgactccatgaagttggaatcgctagtaatcgcgaatcagcaagtcgcggtgaatacgttctcgggccttgtacacaccgcccgtcacaccatgggagtgggttttaccagaaggcggtagattaaccgaaaggggatcgccgaccacggtaggattcatgactggggtgaagtcgtaacaaggtagccgtaggggaacctgcggctggatcacctcctta

SEQ ID NO: 2487 - DNA, 536 bp, Candidatus Saccharibacteria bacterium TM7 ANC 38.39 G1 1
  ref <308>: DATABASE ACCESSION NUMBER: NCBI ACCESSION: NZ_PQNZ01000050.1
  ref <309>: DATABASE ENTRY DATE: 2019-04-01
  ref <313>: RELEVANT RESIDUES IN SEQ ID NO: (1)..(536)
tttatggagagtttgatcctggctcaggatgaacgctggcggcgtgcctaacacatgcaagtcgaacgaaggtatatataggaagtcttcggatggaatatgtataacttagtggcggacgggtgagtaacgcgtaagtaatcaacctgtgacacacggataactgatagaaatgtcagctaatacgagatgaactgtttaaattgggaaatggaaacagcaaagcgaaagcggtcacagacgagcttgcgtctgattagctagttggtggggtaagagcctaccaaggcgacgatcagtagccggcctgagagggtgaacggccacattggaactgagacacggtccaaactcctacgggaggcagcagtggggaatattgcacaatgggggaaaccctgatgcagcaacgccgcgtgaaggaagaaggcctttgggtcgtaaacttctgtccttggggaagaaaaaaatgacggtacccttggaggaagccccggctaactacgtgccagcagccgcggtaatacgtagggggc

SEQ ID NO: 2488 - DNA, 1531 bp, Candidatus Saccharibacteria bacterium TM7 CMJM G6 1 HOT 870
  ref <308>: DATABASE ACCESSION NUMBER: NCBI ACCESSION: NZ_PRLK01000004.1
  ref <309>: DATABASE ENTRY DATE: 2019-04-01
  ref <313>: RELEVANT RESIDUES IN SEQ ID NO: (1)..(1531)
tttatggagagtttgatcctggctcaggattaacgctggcggcgtgcctaacacatgcaagtcgagcggcagcgagttttacactgaattctggaaacttctggtataaatagaagagttattcaagaattttgtgtaaaatgtcggcgagcggcggacggctgagtaacgcgtgggaatgtaccccaaagtgagggataacgcaccgaaaggtgtgctaataccgcatatgatcttcggattaaagccttcgggcgctttgggaacagcctgcgtcagattagatagttggtgaggtaatggctcaccaagtcgacgatctgtaactggtttgagaggatgatcagtcagactggaactgagacacggtccagactcctacgggaggcagcagtgaggaatcttccacaatgggcgaaagcctgatggagcaacgccgcgtgcaggatgaaggccttcgggttgtaaactgcttttataagtgaggattatgacagtaacttatgaataaggatcggctaactacgtgccagcagccgcggtcatacgtaggatccgagcgttatccggagtgactgggcgtaaagagttgcgtaggtggtttaataagcgaatagtgaaatctggtggctcaaccattcagactattattcgaactgttgaactcgagagcagaagaggtagctggaatttctagtgtaggagtgaaatccgtagatattagaaggaacaccgatggcgtaggcaggctactgggctgtttctgacactgaggcacgaaagcgtggggagcgaaccggattagatacccgggtagtccacgccgtaaacgatggatactagctgtttggggtatcgaccccctgagtagcgaagctaacgcgttaagtatcccgcctgtggagtacgatcgcaagattaaaacataaaggaattgacggggacccgcacaagcggtggatcatgttctttaattcgatgataaccgataaaccttaccaggtcttgacatccttggaatctttcagaaatgagagagtgctttttaagagccaagtgacaggtgatgcatggccgtcgtcagctcgtgtcgtgagatgtttggttaagtccatcaacgagcgcaacccttgtgaatagttgtatttttctattcagactgccccggcaacggggaggaaggaggggatgacgtcaggtcagtatttcccttacgtcctgggctagaaacgtgatacaatggctagtacaatgcgcagcgaagccgcgaggtgaagcaaatcgcatcaaagctagtcccagttcggattgtaggctgaaactcgcctgcatgaagtcggaatcgctagtaatcgcagatcagcatgctgcggtgaatacgttcccgggtcttgtacacaccgcccgtcaaaccatgaaagtcactaacacccgaagtccgattcgtcggcctaaggtgggagggatgattggggttaagtcgtaacaaggtatccgtaccggaaggtgcggatggattacctcctttcta

SEQ ID NO: 2489 - DNA, 432 bp, Candidatus Saccharibacteria bacterium TM7 G3 2 Rum HOT 351B
  ref <308>: DATABASE ACCESSION NUMBER: NCBI ACCESSION: NZ_PRLM01000004.1
  ref <309>: DATABASE ENTRY DATE: 2019-04-01
  ref <313>: RELEVANT RESIDUES IN SEQ ID NO: (1)..(432)
gagagtttgatcctggctcaggatgaatgctggcggcgtgcctaatacatgcaagtcgagcggtaacagggtttcaccgtttccttgacacacttggccaacgtgcaagtggaagaattcgagggaacagtgaaactgctgacgagcggcggacggctgagtaacgcgtgggaacggaccccaaactgagggataactactcgaaagagtggctaataccgcatgtgatcttcggattaaaggatttatccggtttgggactggcctgcgtacgattagatagttggtagggtaacggcctaccaagtcgacgatcgttagatggtttgagaagatgatcatccagactgggactgagacacggcccagactcctacgggaggcagcagtagggaatctttcacaatgggcgaaagcctgatggagcaacgc

SEQ ID NO: 2490 - DNA, 1530 bp, Candidatus Saccharibacteria bacterium TM7 KMM G3 1 HOT 351
  ref <308>: DATABASE ACCESSION NUMBER: NCBI ACCESSION: NZ_PRLL01000002.1
  ref <309>: DATABASE ENTRY DATE: 2019-04-01
  ref <313>: RELEVANT RESIDUES IN SEQ ID NO: (1)..(1530)
ttaatggagagtttgatcctggctcaggatgaatgctggcggcatgcctaatacatgcaagtcgagcggtagcatggcttcaccgttctcttgacacacttggctttatgcgagtggtaagattcgagggaactgtgaagctgatgacgagcggcggacggctgagtaacgcgtgagaacataccccaaagtgagggataactagtcgaaagattagctaataccgcatgtgatctttggattaaagcatttatgcgctttgggaatggcttgcgtacgattagatagttggtgaggtaaaggctcaccaagtcgacgatcgttagatggtttgagaggatgatcatccagactgggactgagacacggcccagactcctacgggaggcagcagtagggaatctttcacaatgggcgaaagcctgatggagcaatgccgcgtgcaggacgaaggccttcgggttgtaaactgcttttataagcgagaaatatgatggtaacttatgaataaggatcggctaactacgtgccagcagccgcggtcatacgtaggatccgagcattatccggagtgactgggtgtaaagagttgcgtaggtggcaaggtaagtagatagtgaaatctggtggctcaaccattcagactattatctaaactatctagctcgagactgttatgggtaactggaatttctagtgtaggagtgaaatccgtagatattagaaggaacaccgatagcgtaggcaggttactgggacagttctgacactaaggcacgaaagcgtagggagcaaacgggattagataccccggtagtctacgccgtaaacgatggatactagcagttttgggtatcgacccccggagttgcgaagctaacgcgttaagtatcccacctgtgtagtacgatcgcaagattaaaacataaaggaattgacggggacccgcacaagcggtggagcgtgatctttaattcgatggtaaacgataaaccttaccaaggcttgacatccgatgtaggctctcgaaagagaactgtgccttcgggaacatcgagacaggtgatgcatggccgtcgtcagctcgtgtcgtgagatgtttggttaagtccatcaacgagcgcaacccttgcaaccagttgtatttttctggtaggactgccccggtaacggggaggaaggaggggatgatgtcaggtcagtatttcccttacgccttgggctagaatcgcgctacaatggctggtacaatgcgaagcgaagcagtgatgtgaagcaaatcgcaccaaagccagtcccagttcggatagaaggctgaaactcgccttcttgaagtcggaatcgctagtaatcgcagatcagcatgttgcggtgaatacgttcccgggtcttgtacacaccgcccgtcaaaccatgagagtcaccaacacccgaagtccgcctcggcggcctaaggtgggggagatgattggggttaagtcgtaacaaggcatcggtacgagaacgtgtcgatggattacctcctttcta

SEQ ID NO: 2491 - DNA, 1476 bp, Candidatus Saccharibacteria bacterium YM S32 TM7 50 20
  ref <308>: DATABASE ACCESSION NUMBER: NCBI ACCESSION: NZ_CP025011.1
  ref <309>: DATABASE ENTRY DATE: 2019-04-01
  ref <313>: RELEVANT RESIDUES IN SEQ ID NO: (1)..(1476)
tttttggagagtttgatcctggctcaggatgagcgctggcggcgtgcctaatacatgcaagtcgagcggtaaggcctcttcggaggtacacgagcggcggacggctgagtaacacgtaggaacgtaccccaaagtgagggataactgctcgaaagagtagctaataccgcatgtgatctccggattaaagctttatgcgctttgggaacggcctgcgtccgattagcttgttggtgaggtaaaagcttaccaaggcgacgatcggtagctggtctgagaggatgatcagccagactgggactgagacacggcccagactcctacgggaggcagcagtagggaattttccacaatgggcgaaagcctgatggagcaacgccgcgtgcaggatgaaggccttagggttgtaaactgcttttgttggtgacgattatgacggtaaccaacgaataagggtctgctaactacgtgccagcagccgcggtcatacgtaggacccaagcgttatccggaattactgggcgtaaagagttgcgtaggtggcatagaaagcggatagtgaaagcgtgtggctcaaccatacatccattatctgaactactaagctagaagatgagagaggtagatggaattcttgatgtaggggtaatatccgtagatatcaagaggaacaccgatggcgtaggcagtctactggctcattcttgacactaaggcacgaaagcgtggggagcaaacaggattagataccctggtagtccacgccgtaaactatggatgctagctgtaagccgtatcgacccggcttgtagcgaagctaacgcgttaagcatcccgcctgtggagtacggtcgcaagactaaaacataaaggaattgacggggacccgcacaagcggtggagcgtgttgtttaattcgatggtaaacgaagaaccttacccaggcttgacatcccgagaaggtttccgaaaggaaattgtgccgtaaggaattcggtgacaggtgctgcatggccgtcgtcagctcgtgtcgtgagatgtttggttaagtccatcaacgagcgcaacccctatagttagttgtatttttctagctagactgccctggcaacagggaggaagggggggatgatgtcaggtcagtattgcccttacgtctggggctacaaacacgctacaatggccggtacaaagggcagccaagtcgcaagacggagcaaatcccatcaaagccggtccaagttcggattgcaggctgaaactcgcctgcatgaagctggaatcgctagtaacggtaagtcagctatattaccgtgaatacgttcccgggtcttgtacacaccgcccgtcaaaccatgaaagtcgccaatacctgacgtgttgccttcgcgcagccctaaggtaggggagatgattggggttaagtcgtaacaaggtatccgtacgggaacgtgcggatggattacctcctttcta

SEQ ID NO: 2492 - DNA, 1506 bp, Candidatus Saccharimonas aalborgensis
  ref <308>: DATABASE ACCESSION NUMBER: NCBI ACCESSION: NC_021219.1
  ref <309>: DATABASE ENTRY DATE: 2019-04-01
  ref <313>: RELEVANT RESIDUES IN SEQ ID NO: (1)..(1506)
tttatggagagtttgatcctggctcaggatgaacgctggcggcgtgcctaacacatgcaagtcgaacggtaacaggttctcactatgcttttgaagttttcgaaggtttagtgagaatgctgacgagtggcggacggctgagtaacgcgtgggaacgtgccccaaagtgagggataagcaccggaaacggtgtctaataccgcatatgatcttcggattaaagcagcaatgcgctttgggagcggcctgcgtcggattaggttgttggtgaggtaatggctcaccaagccgacgatccgtagctggtctgagaggatgaccagccagactggaactgagacacggtccagactcctacgggaggcagcagtgaggaatcttccacaatgggggcaaccctgatggagcaacgccgcgtgcaggatgaaggccttcgggtcgtaaactgcttttataagtgaggaatatgacggtaacttatgaataaggatcggctaactacgtgccagcagccgcggtcatacgtaggatccgagcgttatccggagtgactgggcgtaaagagttgcgtaggtggtttgttaagtaggtagtgaaatctggcggctcaaccgtacaggctattacctaaactggcaaactcgagaatggtagaggtcactggaatttctagtgtaggagtgaaatccgtagatattagaaggaacaccaatggcgtaggcaggtgactggaccatttctgacactgaggcacgaaagcgtggggagcgaaccggattagatacccgggtagtccacgctgtaaacgatggatactggctgtttggggtatcgaccccccaagtagcgaagctaacgcgttaagtatcccgcctgtggagtacggtcgcaagactaaaacataaaggaattgacggggacccgcacaagcggtggatcgtgttctttaattcgatgataaacggagaaccttaccagggcttgacatccagggaagcactgcgaaagcagcgtgtgccttttggaaccctgtgacaggtgttgcatggccgtcgtcagctcgtgtcgtgagatgtttggttaagtccatcaacgagcgcaacccttgtgaatagttgtatttttctattcaaactgccccggcaacggggaggaaggaggggatgatgtcaggtcagtattacccttacgtcctgggctagaaacacgatacaatggctagtacaatgcgcagcaaagccgcgaggtggagcaaatcgcatcaaagctagtcccagttcggattggaggctgaaactcgcctccatgaagtcggaatcgctagtaatcgcaaatcagcaagttgcggtgaatacgttcccgggtcttgtacacaccgcccgtcaaaccatgaaagtgaccaacacccgaagtccgattcgtcggcctaaggtggggggcatgattggggttaagtcgtaacaaggtatccgtaccggaaggtgcggatggattacctcctttcta

SEQ ID NO: 2493 - DNA, 1554 bp, Candidatus Soleaferrea massiliensis
  ref <308>: DATABASE ACCESSION NUMBER: NCBI ACCESSION: NZ_CCYH01000050.1
  ref <309>: DATABASE ENTRY DATE: 2019-04-01
  ref <313>: RELEVANT RESIDUES IN SEQ ID NO: (1)..(1554)
taattaagagtttgatcctggctcaggacgaacgctggcggcgcgcttaacacatgcaagtcgaacggggttgtttctgacactcagtgggtaatcggtagattgctgattgagtgttgggaataacctagtggcggacgggtgagtaacacgtgagcaacctacctttcagagggggataacgtttggaaacgaacgctaataccgcatgatataattggatggcatcatctgattatcaaaggagcaatccgctgaaagatgggctcgcggccgattaggtagttggagtggtaacggcacaccaagccgacgatcggtagccggactgagaggttgaacggccacattgggactgagacacggcccagactcctacgggaggcagcagtggggaatattgcacaatgggcgaaagcctgatgcagcgacgccgcgtgagggaagacggttttcggattgtaaacctctgtcttatgtgacgataatgacggtagcataggaggaagccacggctaactacgtgccagcagccgcggtaatacgtaggtggcaagcgttgtccggaattactgggtgtaaagggagcgtaggcgggaatgcaagttgaatgttaaatctaccggctcaaccggtagctgcgttcaaaactgtatttcttgagtgaagtagaggcaggcggaattcctagtgtagcggtgaaatgcgtagatattaggaggaacaccagtggcgaaggcggcctgctgggcttttactgacgctgaggctcgaaagcgtggggagcaaacaggattagataccctggtagtccacgctgtaaacgatgattactaggtgtggggggtctgaccccttccgtgccggagttaacacaataagtaatccacctggggagtacgaccgcaaggttgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttactattagttgctacgcaagagcactctaatgggactgccgttgacaaaacggaggaaggtggggatgacgtcaaatcatcatgccccttatgacctgggccacacacgtactacaatggtgttcaacagagggaagcaaaactgtgaagtggagcaaacccctaaaagacatcccagttcggatcgtaggctgcaacccgcctacgtgaagttggaattgctagtaatcgcggatcagcatgccgcggtgaatacgttcccgggtcttgtacacaccgcccgtcacaccatgagagtcggtaacacccgaagtcagtagcctaaccgcaaggagggcgctgccgaaggtgggattgatgattagggtgaagtcgtaacaaggtagccgtatcggaaggtgcggctggatcacctcctttctaagga

SEQ ID NO: 2494 - DNA, 1501 bp, Candidatus Terasakiella magnetica
  ref <308>: DATABASE ACCESSION NUMBER: NCBI ACCESSION: NZ_FLYE01000021.1
  ref <309>: DATABASE ENTRY DATE: 2019-04-01
  ref <313>: RELEVANT RESIDUES IN SEQ ID NO: (1)..(1501)
aacttgagagtttgatcctggctcagaacgaacgctggcggcaggcctaacacatgcaagtcgagggagaaactatcttcggatagcggagaccggcagacgggtgagtaacacgtgggaacatacctagtagtgggggataacagttggaaacgactgctaataccgcatacgcccttcgggggaaagatttatcgctattagattggcccgcgttagattagctagttggtaaggtaacggcttaccaaggcgacgatctatagctggtttgagaggatgatcagccacactgggactgagacacggcccagactcctacgggaggcagcagtggggaatattgcgcaatggaggaaactctgacgcagccatgccgcgtgagtgaagaaggccttagggttgtaaagctctttcagacgtgatgatgatgacagtagcgtcaaaagaagttccggctaacttcgtgccagcagccgcggtaatacgaagggaactagcgttgttcggatttactgggcgtaaagagcatgtaggcggattggttagttggatgtgaaatcccggagctcaactccggaactgcattcaatactgccagtctagagtctgtaagggggtggtggaattccgagtgtagaggtgaaattcgtagatattcggaggaacaccagtggcgaaggcgaccacctggtacagtactgacgctgagatgcgaaagcgtggggagcaaacaggattagataccctggtagtccacgccgtaaacgatgagtgctagttgtcgggtagtttactactcggtgacgcagctaacgcattaagcactccgcctggggagtacggtcgcaagattaaaactcaaaggaattgacgggggcccgcacaagcggtggagcatgtggtttaattcgaagcaacgcgaagaaccttaccaatccttgacatacttatcgtaggtctgagagatcagacccttcagttcggctggatgagatacaggtgctgcatggctgtcgtcagctcgtgtcgtgagatgttgggttaagtcccgcaacgagcgcaaccctcacccctagttgccagcatttagttgggcactctatgggaactgccggtgacaagccggaggaaggtggggatgacgtcaagtcatcatggcccttacggattgggctacacacgtgctacaatggcagatacagtgggacgcgacctcgcgaggggaagcaaatctccaaaatctgtctcagttcggattgttctctgcaactcgagagcatgaagtcggaatcgctagtaatcgcggatcagcatgccgcggtgaatacgttcccgggccttgtacacaccgcccgtcacaccatgggagttggttttacccgaagatagtgggctaaccttttagggggcagctagccacggtaaggtcagcgactggggtgaagtcgtaacaaggtagccgtaggggaacctgcggctggatcacctcctttcaagg

SEQ ID NO: 2495 - DNA, 1485 bp, Candidatus Viridilinea mediisalina
  ref <308>: DATABASE ACCESSION NUMBER: NCBI ACCESSION: NZ_NQWI01000271.1
  ref <309>: DATABASE ENTRY DATE: 2019-04-01
  ref <313>: RELEVANT RESIDUES IN SEQ ID NO: (1)..(1485)
acgcagagtttgatcctggctcaggacgaacgctggcggcgtgcctaatgcatgcaagtcgaacgcagcaagcttgcttggctgcgtggcgcacggctgaggaacacgtgggtaccaaccccggagtgggggataccccgtcgaaagacgggacaatcccgcatacgatccgcaaggaggaaaggcgcaagccgctctgggacgggcctgcggcccatcaggtagttggtgtggtaagagcgcaccaagccgatgacgggtccctggtctgagaggacgaccaggcagactgggactgagacacggcccagactcctacgggaggcagcagcaaggaattttccccaatgggcgcaagcctgagggagcaacgccgcgtgcaggacgacggccttcgggttgtaaactgcttttgggggggacgatgatgacggtaccccccgaataagccccggctaactccgtgccagcagccgcggtaagacggagggggcaagcgttgtccggaatcactgggcgtaaagcgcgcgtaggcggtacgttgcgtcggtgctgaaagcgccaggcttaacctggcgaggcgtgccgatacgaacgcactggaggcaggcagagggtggcggaattccgggtgtagtggtgaaatgcgtagagatccggaggaacgccggtggtgtagacggccacctgggcctgacctgacgctgaggcgcgaaagcgtggggagcaaaccggattagatacccgggtagtccacgcagtaaacgatgtcggctcggtgtctgacgcccgtacgggtgttgggtgccccagcacacgcggtaagccgaccgcctggggagtacgagcgcaagcttaaaactcaaaggaattgacgggggcccgcacaagcagcggagcgtgtggtttaattcgacgcaacgcgaagaaccttacctaggcttgacatggagctgcacgccggtgaaagccggttccttcgagggtgctccacaggtgctgcatggctgtcgtcagctcgtgtcgtgagatgttgggttaagtcccgcaacgagcgcaacccgcgtcggtagttactcgtgtctaccgagacagccgccttgatgggcggaggaaggcgcggatgacgtcaagtcagcatggcccttacgcctagggcgacacacacgctacaatggccacgacagcgcgtcgccaccccgcaagggggcgcaaatcgtcaaacgtggcctcagttcagattgggggctgcaactcgcccccatgaaggtggagttgctagtaaccgcgtatcagccatggcgcggtgaatacgttcccgggccttgtacacaccgcccgtcacgtcatgggagtggccaatgcttgaagtccgtgggctaacccgcaagggaggcagcggccgagggcaggggtcgcgactgggacgaagtcgtaacaaggtatccgtaccggaaggtgcggatggatcacctcctttctagg

SEQ ID NO: 2496 - DNA, 1237 bp, Candidimonas sp. SYP-B2681
  ref <308>: DATABASE ACCESSION NUMBER: NCBI ACCESSION: NZ_RYDV01000022.1
  ref <309>: DATABASE ENTRY DATE: 2019-04-01
  ref <313>: RELEVANT RESIDUES IN SEQ ID NO: (1)..(1237)
ggacgaccagccacactgggactgagacacggcccagactcctacgggaggcagcagtggggaattttggacaatgggggaaaccctgatccagccatcccgcgtgtgcgatgaaggccttcgggttgtaaagcacttttggcagggaagaaacggcgcgcccgaatacggcgcgtcactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactgccgagctagagtatgtcagaggggggtagaattccacgtgtagcagtgaaatgcgtagagatgtggaggaataccgatggcgaaggcagccccctgggataatactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatttccaagagattggaaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcaagggggagccaatcccagaaacccgatcgtagtccggattggagtctgcaactcgactccatgaagtcggaatcgctagtaatcgcggatcagaatgtcgcggtgaatacgttcccgggtcttgtacacaccgcccgtcacaccatgggagtgggttttaccagaagtagttagcctaaccgcaaggagggcgattaccacggtaggattcatgactggggtgaagtcgtaacaaggtagccgtatcggaaggtgcggctggatcacctccttt

SEQ ID NO: 2497 - DNA, 1528 bp, Caproiciproducens sp. NJN-50
  ref <308>: DATABASE ACCESSION NUMBER: NCBI ACCESSION: NZ_CP035283.1
  ref <309>: DATABASE ENTRY DATE: 2019-04-01
  ref <313>: RELEVANT RESIDUES IN SEQ ID NO: (1)..(1528)
aaattttagagagtttgatcctggctcaggacgaacgctggcggcgtgcctaacacatgcaagtcgaacggaaccatttttgagcttgcttagagatggtttagtggcggacgggtgagtaacgcgtgaggaacctgcctttcagagggggataacgtctggaaacggacgctaataccgcatgatattccggagtcacatggcactggaatcaaaggagcaatccgctgagagatggactcgcgtccgattagccagttggcggggcaacggcccaccaaagcgacgatcggtagccgggctgagaggctgaacggccacattgggactgagacacggcccagactcctacgggaggcagcagtgggggatattgcacaatggaggaaactctgatgcagcaacgccgcgtgagggaagaaggttttcggattgtaaacctctgtcctcagggacgataatgacggtacctgaggaggaagctccggctaactacgtgccagcagccgcggtaatacgtagggagcaagcgttgtccggatttactgggtgtaaagggtgcgtaggcggcactgcaagtcaggtgtgaaaaccatgggcttaactcatggattgcacttgaaactgtggtgcttgagtgaagtagaggcaggcggaattcccggtgtagcggtgaaatgcgtagagatcgggaggaacaccagtggcgaaggcggcctgctgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccttgtgattagttgctacgcaagagcactctaatcagactgccgttgacaaaacggaggaaggtggggacgacgtcaaatcatcatgccccttatgacctgggctacacacgtactacaatggccgttaacaacgggaagcgaagccgcgaggtggagcaaaaccccaaaaacggtctcagttcggatcgcaggctgcaacccgcctgcgtgaagctggaattgctagtaatcgcggatcatcatgccgcggtgaatacgttcccgggccttgtacacaccgcccgtcacaccatgggagccggtaatacccgaagtcggtagcctaaccgcaaggaaggcgccgccgaaggtaggattggcgactggggtgaagtcgtaacaaggtagccgtatcggaaggtgcggctggatcacctcctttctatgga

SEQ ID NO: 2498 - DNA, 1512 bp, Capsulimonas corticalis
  ref <308>: DATABASE ACCESSION NUMBER: NCBI ACCESSION: NZ_BHFQ01000059.1
  ref <309>: DATABASE ENTRY DATE: 2019-04-01
  ref <313>: RELEVANT RESIDUES IN SEQ ID NO: (1)..(1512)
ttcatggagagtttgatcctggctcaggacgaacgcttgcgacgtgcctaagaaatgcaagtcgaacggggtagcaatacctagtggcgaacggtcgcgtaacacgtgggcaacctgccttgaagcgggggacaacaatccgaaagggttgctaataccgcatgtgaacttttgtggcatcacgaaatgttcaaagctttatgcacttcaagatgggcccgcggcctatcagctagttggtggggtaacggcctaccaaggcttcgacgggtagctggtctgagaggacgatcagccggattgggactgagatacggcccagactcctacggggggcagcaattaggaatcttgcgcaatgggggcaaccctgacgcagcgacgtcgcgtggaggatgaaatctttcgggatgtaaactccttttaccagggaagaaacaaatgacggtacctggtgaataagccccggctaactacgtgccagcagccgcggtaatacgtagggggcgagcgttgtccgaagttactgggcgtaaagcgcgtgtaggcgggtctttaagtgaggggtgaaaggttcgggcttaacccggacactgcctttcatactggagaccttgagtgcgggagaggcgagtggaatggtcggtgtagcggtgaaatgcgtagatatcgatcggaacacccatggcgaaggcagctcgctggcctgtaactgacgctgagacgcgaaagcgtggggagcaaacaggattagataccctggtagtccacgccgtaaacgatgagtgctaggtgtcaggggtatcgacccccctggtgccgcagctaacgcaataagcactccgcctggggagtacggccgcaaggttgaaactcaaaggaattgacgggggcccgcacaagcggtggagcatgtgcattaattcgtcactaaccgaagaaccttaccagggtttgacatctctggacatcccatgaaagtgggctttcctcgcaagaggaccagaagacaggtgttgcatggttgtcgtcagctcgtgtcgtgagatgttgggttaagtcccgcaacgagcgcaaccctcacccaatgttgccagcgtgaaagacgggaactctttgggaactgcccgtgtaagcgggaggaaggtggggatgacgtcaaatcggcatggcccttacatcctgggcttgacacatgctacaatggctgttaacaaagggacgcaagaccgcgaggtggagccaatctcaaaaatacagtctcagttcagattgcaggctgcaactcgcctgcatgaagtcggaatcgctagtaaccgcaggtcagctaaactgcggtgaatacgttcccgggccttgtacacactgcccgtcaagtcacctgagttgtctgcacccgaagccgatggcctaaccgcaaggaaggagtcgtctaaggtgtggggagcgagggggactaagtcgtaacaaggtagccgtatcggaaggtgcggctggatcacctcctttcta

SEQ ID NO: 2499 - DNA, 523 bp, Carboxydocella sp. JDF658
  ref <308>: DATABASE ACCESSION NUMBER: NCBI ACCESSION: NZ_BDLR01000120.1
  ref <309>: DATABASE ENTRY DATE: 2019-04-01
  ref <313>: RELEVANT RESIDUES IN SEQ ID NO: (1)..(523)
ggtcaagacatccatacaggtggtgcatggttgtcgtcagctcgtgtcgtgagatgttgggttaagtcccgcaacgagcgcaacccctatgcttagttgccagcacggaaggtgggcactctaggcagactgccggtgacaaaccggaggaaggtggggatgacgtcaaatcatcatgccccttatgtcctgggctacacacgtgctacaatggccggtacagagggcagcgaagccgtgaggcggagcaaatcccaaaaagccggtcccagttcggattgcaggctgcaactcgcctgcatgaagtcggaatcgctagtaatcgcaggtcagcaaactgcggtgaatacgttcccgggccttgtacacaccgcccgtcacaccacgaaagtctgcaacacccgaagccggtgggctaaccgcaaggaggcagccgtcgaaggtggggcagatgattggggtgaagtcgtaacaaggtagccgtatcggaaggtgcggctggatcacctcctttctaaggaga

SEQ ID NO: 2500 - DNA, 958 bp, Carboxydocella sp. ULO1
  ref <308>: DATABASE ACCESSION NUMBER: NCBI ACCESSION: NZ_BDLQ01000069.1
  ref <309>: DATABASE ENTRY DATE: 2019-04-01
  ref <313>: RELEVANT RESIDUES IN SEQ ID NO: (1)..(958)
ggcttagcggcggacgggtgagtaacgcgtgagcaacctgcccttcagacagggataacaccgcgaaagtggtgctaatacctggtacactctttgcatcgcatgaagcagggaggaaaggtggcctctggaacaagctaccgctgaaggatgggctcgcgtcccattagctagttggtgaggtaacggctcaccaaggcgacgatgggtagccggcctgagagggtgaccggccacactgggactgagacacggcccagactcctacgggaggcagcagtggggaatcttccgcaatgggcgaaagcctgacggagcaacgccgcgtgggtgaagaaggccttcgggtcgtaaagccctgtcttcagggacgaagtctcacctgtgaagaatgggtgaaggtgacggtacctgaggaggaagccccggctaactacgtgccagcagccgcggtaaaacgtagggggcgagcgttatccggaattactgggcgtaaagcgcgtgtaggcgggctgttaagtcggttgtgaaaatccggggctcaacttcggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacaggattagataccctggtagtccacgccgtaaacgatgggtactaggtgttggaggtatcgaacccttcagtgccgtagtaaacacaataagtaccccgcctggggagtacggccgcaaggctgaaactcaaaggaattgacgggggcccgcacaagcggtggagcatgtggtttaattcgaagcaacacgaagaaccttaccagggcttgacatatggatgacagctgcagagatgtggcgttcttggctt

SEQ ID NO: 2501 - DNA, 1570 bp, Carboxydocella sporoproducens
  ref <308>: DATABASE ACCESSION NUMBER: NCBI ACCESSION: NZ_FUXM01000083.1
  ref <309>: DATABASE ENTRY DATE: 2019-04-01
  ref <313>: RELEVANT RESIDUES IN SEQ ID NO: (1)..(1570)
attcggagagtttgatcctggctcaggatgaacgctggcggcgtgcctaacacatgcaagtcgagcggagccgtgagggagcttgctcctgagcggcttagcggcggacgggtgagtaacgcgtgagcaacctgcccttcagacagggataacaccgcgaaagtggtgctaatacctggtacactctttgcatcgcatgaagcagggaggaaaggtggcctctggaacaagctaccgctgaaggatgggctcgcgtcccattagctagttggtgaggtaacggctcaccaaggcgacgatgggtagccggcctgagagggtgaccggccacactgggactgagacacggcccagactcctacgggaggcagcagtggggaatcttccgcaatgggcgaaagcctgacggagcaacgccgcgtgggtgaagaaggccttcgggtcgtaaagccctgtcttcagggacgaagtctcacctgtgaagaatgggtgaaggtgacggtacctgaggaggaagccccggctaactacgtgccagcagccgcggtaaaacgtagggggcgagcgttatccggaattactgggcgtaaagcgcgtgtaggcgggctgttaagtcggttgtgaaaatccggggctcaacttcggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacaggattagataccctggtagtccacgccgtaaacgatgggtactaggtgttggaggtatcgaacccttcagtgccgtagtaaacacaataagtaccccgcctggggagtacggccgcaaggctgaaactcaaaggaattgacgggggcccgcacaagcggtggagcatgtggtttaattcgaagcaacacgaagaaccttaccagggcttgacatatggatgacagctgcagagatgtagcgttcttggcttcggtcaagacatccatacaggtggtgcatggttgtcgtcagctcgtgtcgtgagatgttgggttaagtcccgcaacgagcgcaacccctatgcttagttgccagcacggaaggtgggcactctaggcagactgccggtgacaaaccggaggaaggtggggatgacgtcaaatcatcatgccccttatgtcctgggctacacacgtgctacaatggccggtacagagggcagcgaagccgtgaggcggagcaaatcccaaaaagccggtcccagttcggattgcaggctgcaactcgcctgcatgaagtcggaatcgctagtaatcgcaggtcagcaaactgcggtgaatacgttcccgggccttgtacacaccgcccgtcacaccacgaaagtctgcaacacccgaagccggtgggctaaccgcaaggaggcagccgtcgaaggtggggcagatgattggggtgaagtcgtaacaaggtagccgtatcggaaggtgcggctggatcacctcctttcta

SEQ ID NO: 2502 - DNA, 1571 bp, Carboxydocella thermautotrophica
  ref <308>: DATABASE ACCESSION NUMBER: NCBI ACCESSION: NZ_CP028514.1
  ref <309>: DATABASE ENTRY DATE: 2019-04-01
  ref <313>: RELEVANT RESIDUES IN SEQ ID NO: (1)..(1571)
attcggagagtttgatcctggctcaggatgaacgctggcggcgtgcctaacacatgcaagtcgagcggagccgtgagggagcttgctcctgagcggcttagcggcggacgggtgagtaacgcgtgagcaacctgcccttcagacagggataacaccgcgaaagtggtgctaatacctggtacactctttgcatcgcatgaagcagggaggaaaggtggcctctggaacaagctaccgctgaaggatgggctcgcgtcccattagctagttggtgaggtaacggctcaccaaggcgacgatgggtagccggcctgagagggtgaccggccacactgggactgagacacggcccagactcctacgggaggcagcagtggggaatcttccgcaatgggcgaaagcctgacggagcaacgccgcgtgggtgaagaaggccttcgggtcgtaaagccctgtcttcagggacgaagtctcacctgtgaagaatgggtgaaggtgacggtacctgaggaggaagccccggctaactacgtgccagcagccgcggtaaaacgtagggggcgagcgttatccggaattactgggcgtaaagcgcgtgtaggcgggctgttaagtcggttgtgaaaatccggggctcaacttcggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacaggattagataccctggtagtccacgccgtaaacgatgggtactaggtgttggaggtatcgaacccttcagtgccgtagtaaacacaataagtaccccgcctggggagtacggccgcaaggctgaaactcaaaggaattgacgggggcccgcacaagcggtggagcatgtggtttaattcgaagcaacacgaagaaccttaccagggcttgacatatggatgacagctgcagagatgtggcgttcttggcttcggtcaagacatccatacaggtggtgcatggttgtcgtcagctcgtgtcgtgagatgttgggttaagtcccgcaacgagcgcaacccctatgcttagttgccagcacgggaaggtgggcactctaggcagactgccggtgacaaaccggaggaaggtggggatgacgtcaaatcatcatgccccttatgtcctgggctacacacgtgctacaatggccggtacagagggcagcgaagccgtgaggcggagcaaatcccaaaaagccggtcccagttcggattgcaggctgcaactcgcctgcatgaagtcggaatcgctagtaatcgcaggtcagcaaactgcggtgaatacgttcccgggccttgtacacaccgcccgtcacaccacgaaagtctgcaacacccgaagccggtgggctaaccgcaaggaggcagccgtcgaaggtggggcagatgattggggtgaagtcgtaacaaggtagccgtatcggaaggtgcggctggatcacctcctttcta

SEQ ID NO: 2503 - DNA, 280 bp, Carboxydothermus ferrireducens
  ref <308>: DATABASE ACCESSION NUMBER: NCBI ACCESSION: NZ_ATYG01000003.1
  ref <309>: DATABASE ENTRY DATE: 2019-04-01
  ref <313>: RELEVANT RESIDUES IN SEQ ID NO: (1)..(280)
aatggagggtttgatcctggctcaggacgaacgctggcggcgtgcctaacacatgcaagtcgagcggtcctggaggttggcttgccaaccttcaggatagcggcggacgggtgagtaacgcgtgggtgacctacctgtaagaccgggataaccctgggaaaccggggctaataccggatacgctatcgggtttagagacctgataggaaaggtggctgaggcgggagcatgctaccgcttacagatgggcccgcgtcctattagctagttggtggggtaa

SEQ ID NO: 2504 - DNA, 1582 bp, Carboxydothermus hydrogenoformans
  ref <308>: DATABASE ACCESSION NUMBER: NCBI ACCESSION: NC_007503.1
  ref <309>: DATABASE ENTRY DATE: 2019-04-01
  ref <313>: RELEVANT RESIDUES IN SEQ ID NO: (1)..(1582)
taaatggagggtttgatcctggctcaggacgaacgctggcggcgtgcctaacacatgcaagtcgagcgggggaagcggttgagcttgctcaactgtttccttagcggcggacgggtgagtaacgcgtgggtgacctacctgtaagaccgggataaccctgggaaaccggggctaataccggatacgctatcgggagtagaggcctgataggaaagggtggctgaggctttagcatgctaccgcttacagatgggcccgcgtcctattagctagttggtagggtaatggcctaccaaggcgacgatgggtagccggcctgagagggtgaccggccacactgggactgagacacggcccagactcctacgggaggcagcagtgggggatattccgcaatgggcgaaagcctgacggagcgacgccgcgtgggggaagaaggccttcgggttgtaaacccctgtcttccgggacgaagttcactcattcgaaaagggtgagtggatgacggtaccggaggaggaagccccggctaactacgtgccagcagccgcggtaaaacgtagggggcgagcgttgtccggaattactgggcgtaaagagctcgtaggcggtctggtaagtcaggtgtaaaaggccacggctcaaccgtgggggagcacctgatactgctggacttgagggcaggagaggagagtggaattcccggtgtagcggtgaaatgcgtagatatcgggaggaacaccagtggcgaaggcggctctctggactgaacctgacgctgaggagcgaaagccaggggagcgaaccggattagatacccgggtagtcctggccgtaaacgatgggtgctaggtgtggggccggaaaggttccgtgccggaggtaacccaataagcaccccgcctggggagtacggccgcaaggttgaaactcaaaggaattgacgggggcccgcacaagcagtggagcatgtggtttaattcgacgcaacccgaagaaccttaccagggcttgacatccgcggaacctggtggaaacaccggggtgcctgccggaaggtaggaaccgcgagacaggtgctgcatggttgtcgtcagctcgtgtcgtgagatgttgggttaagtcccgcaacgagcgcaacccctacccttagttgccagcgtaaagacgggcactctaaggggactgccatcgataagatggaggaaggtggggatgacgtcaaatcatcatggcctttatgccctgggctacacacgtgctacaatgggcggtacaaagggaagcgaaggggcgacctggagcaaatcccaaaaagccgctctcagttcggattgcaggctgcaactcgcctgcatgaagtcggaattgctagtaatcgcggatcagcatgccgcggtgaatacgttcccgggccttgtacacaccgcccgtcacaccacgaaagccggtaacacccgaagtcagtggcctaacccggaaagggagggagctgccgaaggtgggaccggtgattggggtgaagtcgtaacaaggtagccgtatcggaaggtgcggctggatcacctcctttctaaggaga

SEQ ID NO: 2505 - DNA, 1532 bp, Cardinium endosymbiont of Encarsia pergandiella
  ref <308>: DATABASE ACCESSION NUMBER: NCBI ACCESSION: NC_018605.1
  ref <309>: DATABASE ENTRY DATE: 2019-04-01
  ref <313>: RELEVANT RESIDUES IN SEQ ID NO: (1)..(1532)
atagaaagaagagtttgatcctggctcaggatgaacgctagcggcaggcctcatacatgcaagtcgaggggcagcgaaacacttcggtgttgtcggcgaccggcgaacgggtgcgtaatgcgcatgcaatctactttacactggggaatagcctccggaaacgggaattaataccccatataatcttattaacccatgttaaaaagataaaagctccggcggtgtaaaatgagcgtgcgtcctattagctagttggtgaggcaatggctcaccaaggctacgatgggtaggggttcttagtggaagatcccccacactggcactgagatacgggccagactcctacgggaggcagcagtagggaatattggtcaatgggcgcaagcctgaaccagccatgccgcgtgcaggatgaaagctctctgagttgtaaactgcttttgtacaggagcaaaacaatccctgcggggattcttgagagtactgtaagaataagcaccggctaattccgtgccagcagccgcggtaatacggaaggtgcaagcgttatccggttttattgggtttaaagggtgcgtaggcggcttattaagtcagttgtgaaatcctagtgcttaacgctagaactgcaattgatactattaggcttgagttaagaataggtaagtagaatttatggtgtagtagtgaaatgcttagatatcataaggaataccaatagcgtaggcagcttactggtctttaactgacgctgaggcacgaaagcgtggggagcaaacaggattagataccctggtagtccacgccgtaaacgatgatcactcgatatacataaactttatgtgtgtctaagcgaaagcgttaagtgatccacctggggagtatactcgcaagggtgaaactcaaaggaattgacgggggtccgcacaagcggtggagtatgtggtttaattcgataatacgcgaggaaccttacctgggctagaatgtattttgctactttgagaaattaaaggttcctttgggacaaaatacaaggtgctgcatggctgtcgtcagctcgtgccgtgaggtgttgggttaagtcctataacgagcgaaacccttttacttaattgccagcacgtaatggtgggaactttaagtagactgcccgtgtaagcgggaggaaggagaggatgaggtcaagtcatcatggcctttatgcccagggctacacacgtactacaatggcatgtacaaaaggaagctacttggtaacaagatgcaaatctcaaaagcatgtctcagttcggattgaggtctgcaattcgacctcatgaagttggaatcgctagtaatcgcgtatcagcaatgacgcggtgaatacgttctcggaccttgtacacaccgcccatcaagccatgggagttggtagagcttgaagacagtggccgtaacaggagctgtttagtgttagaccagcgactggggctaagttgtaacaaggtagccgtaccggaaggtgtggctggaatatctcttttatagag

SEQ ID NO: 2506 - DNA, 1537 bp, Cardiobacterium hominis
  ref <308>: DATABASE ACCESSION NUMBER: NCBI ACCESSION: NZ_LR134365.1
  ref <309>: DATABASE ENTRY DATE: 2019-04-01
  ref <313>: RELEVANT RESIDUES IN SEQ ID NO: (1)..(1537)
gaactgaagagtttgattctggctcagattgaacgctggcggcatgcttaacacatgcaagtcgaacggaaacgatggagcttgctccaggcgtcgagtggcggacgggtgagtaacgcatgggaatctgccttttgctgggggataacgtagggaaacttacgctaataccgcataagacctaagggtgaaagcgggggaccgaaaggcctcgcggcaagagatgagcccatgttggattagctagttggtggggtaaaggcctaccaaggcgacgatccatagctggtctgagaggatgatcagccacactgggactgagacacggcccagactcctacgggaggcagcagtggggaatattggacaatggggggaaccctgatccagcaatgccgcgtgtgtgaagaaggccttcgggttgtaaagcactttcagtagggaggaaaggtgcgtagttaatacctgcgcaattgacgttacctacagaagaagcaccggctaactccgtgccagcagccgcggtaatacggagggtgcgagcgttattcggaattactgggcgtaaagcgcacgcaggcggttgcccaagtcagatgtgaaagccccgggcttaacctgggaactgcatttgaaactgggcgactagagtatgaaagaggaaagcggaatttccagtgtagcagtgaaatgcgtagatattggaaggaacaccgatggcgaaggcagctttctgggtcgatactgacgctcatgtgcgaaagcgtggggagcaaacaggattagataccctggtagtccacgccctaaacgatgtcaactaggcgtcgggttgttaaagactcggtgccggagctaacgcattaagttgaccgcctggggagtacggccgcaaggttgaaactcaaagaaattgacggggacccgcacaagcggtggagcatgtggtttaattcgatgcaacgcgaagaaccttaccaggccttgacatcctaggaacttggcagagatgccttggtgccttcgggaacctagagacaggtgttgcatggctgtcgtcagctcgtgtcgtgagatgttgggttaagtcccgcaacgagcgcaacccttatccttacttgccagcactttgggtgggaactgtaaggagactgccggtgacaaaccggaggaaggtggggatgacgtcaagtcatcatggcccttacggcctgggctacacacgtgctacaatggtcggtacagacggtagcgaagccgcgaggtggagccaatctgagaaagccgatcgtagtccggattgcagtctgcaactcgactgcatgaagtcggaatcgctagtaatcgcgaatcagcatgtcgcggtgaatacgttcccgggtcttgtacacactgcccgtcacaccatgggagtttgttgcaccagaagcaggtagcttaacttaggagggcgcttgccacggtgtggccgatgactggggtgaagtcgtaacaaggtaaccgtaggggaacctgcggttggatcacctcctttaaa

SEQ ID NO: 2507 - DNA, 1543 bp, Cardiobacterium valvarum
  ref <308>: DATABASE ACCESSION NUMBER: NCBI ACCESSION: NZ_UFUW01000001.1
  ref <309>: DATABASE ENTRY DATE: 2019-04-01
  ref <313>: RELEVANT RESIDUES IN SEQ ID NO: (1)..(1543)
aagaataaactgaagagtttgattctggctcagattgaacgctggcggcatgcttaacacatgcaagtcgaacggaaacgacggagcttgctccgggcgtcgagtggcggacgggtgagtaatgcatgggaatctgccttttgctgggggataacgtagggaaacttacgctaataccgcataagacctgagggtgaaagtgggggaccgttaaggcctcacggcagaagatgagcccatgtcggattagctagttggtggggtaaaggcctaccaaggcgacgatccgtagctggtctgagaggatgatcagccacactgggactgagacacggcccagactcctacgggaggcagcagtggggaatattggacaatgggggcaaccctgatccagcaatgccgcgtgtgtgaagaaggccttcgggttgtaaagcactttcagcagggaggaaagcatcatggttaacacccatggtagtgacgttacctgcagaagaagcaccggctaactccgtgccagcagccgcggtaatacggagggtgcaagcgttattcggaattactgggcgtaaagcgcacgcaggcggctacctaagtcagatgtgaaagccccgggcttaacctgggaactgcatttgaaactgggcagctagagtatgaaagaggaaagcggaatttccagtgtagcagtgaaatgcgtagatattggaaggaacaccgatggcgaaggcagctttctgggtcgatactgacgctcatgtgcgaaagcgtggggagcaaacaggattagataccctggtagtccacgccctaaacgatgtcaactaggcgtcgggttgtatagactcggtgccgcagctaacgcattaagttgaccgcctggggagtacggccgcaaggttgaaactcaaagaaattgacggggacccgcacaagcggtggagcatgtggtttaattcgatgcaacgcgaagaaccttaccaggccttgacatccagagaacttagcagagatgctttggtgccttcgggaactctgagacaggtgttgcatggctgtcgtcagctcgtgtcgtgagatgttgggttaagtcccgcaacgagcgcaacccttatccttacttgccagcacttagggtgggaactgtaaggagactgccggtgacaagccggaggaaggtggggatgacgtcaagtcatcatggcccttacggcctgggctacacacgtgctacaatggtcggtacagacggtagcgaagccgcgaggtggagccaatctgagaaagccgatcgtagtccggattgcagtctgcaactcgactgcatgaagtcggaatcgctagtaatcgcgaatcagcatgtcgcggtgaatacgttcccgggtcttgtacacactgcccgtcacaccatgggagtttgttgcaccagaagcaggtagcttaacgaaagagggcgcttgccacggtgtggccgatgactggggtgaagtcgtaacaaggtaaccgtaggggaacctgcggttggatcacctcctttaaa

SEQ ID NO: 2508 - DNA, 1573 bp, Carnobacterium alterfunditum
  ref <308>: DATABASE ACCESSION NUMBER: NCBI ACCESSION: NZ_FSRN01000001.1
  ref <309>: DATABASE ENTRY DATE: 2019-04-01
  ref <313>: RELEVANT RESIDUES IN SEQ ID NO: (1)..(1573)
attttatatgagagtttgatcctggctcaggacgaacgctggcggcatgcctaatacatgcaagtcgaacgctttgatttcaccgggtgcttgcacccaccgaagtcaaggagtggcggacgggtgagtaacacgtgggtaacctgcccataagagggggataacattcggaaacggatgctaataccgcatatttctaaacgtcacatgacgaatagaagaaaggtggcttcggctaccgcttatggatggacccgcggcgtattagctagttggtgaggtaatggctcaccaaggcgatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggaaggtcattggaaactggggaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgacaaccctagagatagggctttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaaagtcgcgaggctaagctaatctcttaaagccattctcagttcggattgtaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2509 - DNA, 1563 bp, Carnobacterium divergens
  ref <308>: DATABASE ACCESSION NUMBER: NCBI ACCESSION: NZ_UFVP01000001.1
  ref <309>: DATABASE ENTRY DATE: 2019-04-01
  ref <313>: RELEVANT RESIDUES IN SEQ ID NO: (1)..(1563)
ttatatgagagtttgatcctggctcaggacgaacgctggcggcatgcctaatacatgcaagtcgaacgcacgaagttgaaaagcttgcttttcgaccaagtgagtggcggacgggtgagtaacacgtgggtaacctgcccataagagggggataacattcggaaacggatgctaataccgcatatttcaagtgaccgcatggtcgcttgatgaaaggtggcttcggctaccacttatggatggacccgcggtgcattagttagttggtgaggtaatggctcaccaagaccatgatgcatagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgctgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggatggtacaacgagtcgcgaagtcgtgaggccaagctaatctcttaaagccattctcagttcggattgtaggctgcaactcgcctacatgaagccggaatcgctagtaatcgcggatcagaacgccgcggtgaatacgttcccgggtcttgtacacaccgcccgtcacaccacgagagtttgtaacacccgaagccggtgaggtaaccttttaggagccagccgtctaaggtgggatagataattggggtgaagtcgtaacaaggtagccgtatcggaaggtgcggctggatcacctcctttctaaggaa

SEQ ID NO: 2510 - DNA, 1569 bp, Carnobacterium funditum
  ref <308>: DATABASE ACCESSION NUMBER: NCBI ACCESSION: NZ_JQLL01000001.1
  ref <309>: DATABASE ENTRY DATE: 2019-04-01
  ref <313>: RELEVANT RESIDUES IN SEQ ID NO: (1)..(1569)
ttttatgagagtttgatcctggctcaggacgaacgctggcggcatgcctaatacatgcaagtcgaacgcttctttcctattgagtgcttgcactcgactggaaagaggagtggcggacgggtgagtaacacgtgggtaacctgcccataagtgggggataacattcggaaacggatgctaataccgcataattctgattgccgcatggcgaacggatgaaaggtggcttcggctaccgcttatggatggacccgcggcgtattagctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccatggctaactacgtgccagcagccgcggtaatacgtagatggcaagcgttgtccggatttattgggcgtaaagcgagcgcaggcggttctttaagtctgatgtgaaagaccccagctcaactggggaaggtcattggaaactggagaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaagatcgcgaggtcaagctaatctcttaaagccattctcagttcggattgcaggctgcaactcgcctgcatgaagccggaatcgctagtaatcgcggatcagaacgccgcggtgaatacgttcccgggtcttgtacacaccgcccgtcacaccacgagagtttgtaacacccgaagtcggtgaggtaacccttttgggagccagccgcctaaggtgggatagataattggggtgaagtcgtaacaaggtagccgtatcggaaggtgcggctggatcacctcctttctaagga

SEQ ID NO: 2511 - DNA, 1565 bp, Carnobacterium gallinarum
  ref <308>: DATABASE ACCESSION NUMBER: NCBI ACCESSION: NZ_JQLU01000005.1
  ref <309>: DATABASE ENTRY DATE: 2019-04-01
  ref <313>: RELEVANT RESIDUES IN SEQ ID NO: (1)..(1565)
ttttatatgagagtttgatcctggctcaggacgaacgctggcggcgtgcctaatacatgcaagtcgaacgcacgaagttggaaagcttgctttctaaccaagtgagtggcggacgggtgagtaacacgtgggtaacctgcccataagagggggataacattcggaaacggatgctaataccgcatagtttcaggaatcgcatgattcttgaaggaaaggtggcttcggctaccacttatggatggacccgcggcgtattagctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttaaagaagaataaggatgagagtaactgctcatcccctgacggtatttaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccttattgttagttgccagcattcagttgggcactctagcaagactgccggtgacaaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagaacgccgcggtgaatacgttcccgggtcttgtacacaccgcccgtcacaccacgagagtttgtaacacccgaagccggtgaggtaaccttttaggagccagccgtctaaggtgggatagataattggggtgaagtcgtaacaaggtagccgtatcggaaggtgcggctggatcacctcctttctaaggaa

SEQ ID NO: 2512 - DNA, 1565 bp, Carnobacterium iners
  ref <308>: DATABASE ACCESSION NUMBER: NCBI ACCESSION: NZ_FXBJ01000002.1
  ref <309>: DATABASE ENTRY DATE: 2019-04-01
  ref <313>: RELEVANT RESIDUES IN SEQ ID NO: (1)..(1565)
ttttatgagagtttgatcctggctcaggacgaacgctggcggcatgcctaatacatgcaagtcgaacgcttctactattgagtgcttgcactcgatagtagaggagtggcggacgggtgagtaacacgtgggtaacctgcccataagtgggggataacattcggaaacggatgctaataccgcataattctgattgccgcatggcagacagatgaaaggtggcttcggctaccgcttatggatggacccgcggcgtattagctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccatggctaactacgtgccagcagccgcggtaatacgtagatggcaagcgttgtccggatttattgggcgtaaagcgagcgcaggcggttctttaagtctgatgtgaaagaccccagctcaactggggaaggtcattggaaactggagaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaagatcgcgaggtcaagctaatctcttaaagccattctcagttcggattgcaggctgcaactcgcctgcatgaagccggaatcgctagtaatcgcggatcagaacgccgcggtgaatacgttcccgggtcttgtacacaccgcccgtcacaccacgagagtttgtaacacccgaagtcggtgaggtaacccttttgggagccagccgcctaaggtgggatagataattggggtgaagtcgtaacaaggtagccgtatcggaaggtgcggctggatcacctcctttctaagga

SEQ ID NO: 2513 - DNA, 1573 bp, Carnobacterium inhibens
  ref <308>: DATABASE ACCESSION NUMBER: NCBI ACCESSION: NZ_JQIV01000006.1
  ref <309>: DATABASE ENTRY DATE: 2019-04-01
  ref <313>: RELEVANT RESIDUES IN SEQ ID NO: (1)..(1573)
attttatatgagagtttgatcctggctcaggacgaacgctggcggcatgcctaatacatgcaagtcgaacgcttttgtttcaccgggtgcttgcacccaccgagacaaaagagtggcggacgggtgagtaacacgtgggtaacctgcccataagagggggataacatccggaaacggatgctaataccgcatatttccaattgtctcctgacagatggaaaaaaggtggcttcggctaccgcttatggatggacccgcggcgtattagctagttggtgaggtaatggctcaccaaggcgatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgacaatcctagagataggactttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2514 - DNA, 1574 bp, Carnobacterium jeotgali
  ref <308>: DATABASE ACCESSION NUMBER: NCBI ACCESSION: NZ_JQNF01000007.1
  ref <309>: DATABASE ENTRY DATE: 2019-04-01
  ref <313>: RELEVANT RESIDUES IN SEQ ID NO: (1)..(1574)
attttatatgagagtttgatcctggctcaggacgaacgctggcggcatgcctaatacatgcaagtcgaacgctttaatttcaccgggtgcttgcacccatcgaagttaaggagtggcggacgggtgagtaacacgtgggtaacctgcccataagagggggataacattcggaaacggatgctaataccgcatatttctaatcgtctcctgacgaatggaagaaaggtggcttcggctaccgcttatggatggacccgcggcgtattagctagttggtgaggtaatggctcaccaaggcgatgatacgtagccgacctgagagggtgatcggccacactgggactgagacacggcccagacttcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgacaatcctagagataggactttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2515 - DNA, 1566 bp, Carnobacterium maltaromaticum
  ref <308>: DATABASE ACCESSION NUMBER: NCBI ACCESSION: NZ_CVMZ01000071.1
  ref <309>: DATABASE ENTRY DATE: 2019-04-01
  ref <313>: RELEVANT RESIDUES IN SEQ ID NO: (1)..(1566)
attttatatgagagtttgatcctggctcaggacgaacgctggcggcgtgcctaatacatgcaagtcgaacgcacgaagttgaagagcttgctctttgaccaagtgagtggcggacgggtgagtaacacgtgggtaacctgcccattagagggggataacattcggaaacggatgctaataccgcatagtttcaggaatcgcatgattcttgaaggaaaggtggcttcggctaccactaatggatggacccgcggcgtattagctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttaaagaagaacaaggatgagagtaactgctcatcccctgacggtatttaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagaacgccgcggtgaatacgttcccgggtcttgtacacaccgcccgtcacaccacgagagtttgtaacacccgaagccggtgaggtaaccttttaggagccagccgtctaaggtgggatagataattggggtgaagtcgtaacaaggtagccgtatcggaaggtgcggctggatcacctcctttctaaggaa

SEQ ID NO: 2516 - DNA, 1573 bp, Carnobacterium mobile
  ref <308>: DATABASE ACCESSION NUMBER: NCBI ACCESSION: NZ_JQMR01000001.1
  ref <309>: DATABASE ENTRY DATE: 2019-04-01
  ref <313>: RELEVANT RESIDUES IN SEQ ID NO: (1)..(1573)
tacttttatgagagtttgatcctggctcaggacgaacgctggcggcatgcctaatacatgcaagtcgaacgctttgattctaccgggtgcttgcacccaccagaatcaaagagtggcggacgggtgagtaacacgtgggtaacctgcccataagtgggggataacattcggaaacggatgctaataccgcataactccaaccacctcctggtggatggataaaagacggtttcggctgtcgcttatggatggacccgcggcgtattagctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagcgtaactactcatcccctgacggtatctaaccagaaagccatggctaactacgtgccagcagccgcggtaatacgtagatggcaagcgttgtccggatttattgggcgtaaagcgagcgcaggcggttctttaagtctgatgtgaaagcccccagctcaactggggaaggtcattggaaactggggaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattcagttgggcactctagtgagactgccggtgataaaccggaggaaggtggggatgacgtcaaatcatcatgccccttatgacctgggctacacacgtgctacaatggatggtacaacgagtcgcaagaccgcgaggtcaagctaatctcttaaagccattctcagttcggattgcaggctgcaactcgcctgcatgaagccggaatcgctagtaatcgcggatcagaacgccgcggtgaatacgttcccgggtcttgtacacaccgcccgtcacaccacgagagtttgtaacacccgaagtcggtgaggtaacccttttgggagccagccgcctaaggtgggatagataattggggtgaagtcgtaacaaggtagccgtatcggaaggtgcggctggatcacctcctttctaaggaa

SEQ ID NO: 2517 - DNA, 1573 bp, Carnobacterium pleistocenium
  ref <308>: DATABASE ACCESSION NUMBER: NCBI ACCESSION: NZ_JQLQ01000002.1
  ref <309>: DATABASE ENTRY DATE: 2019-04-01
  ref <313>: RELEVANT RESIDUES IN SEQ ID NO: (1)..(1573)
attttatatgagagtttgatcctggctcaggacgaacgctggcggcatgcctaatacatgcaagtcgaacgctttgatttcaccgggtgcttgcacccaccgaagtcaaggagtggcggacgggtgagtaacacgtgggtaacctgcccataagagggggataacattcggaaacggatgctaataccgcatatttctaaacgtcacatgacgaatagaagaaaggtggcttcggctaccgcttatggatggacccgcggcgtattagctagttggtgaggtaatggctcaccaaggcgatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggaaggtcattggaaactggggaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2518 - DNA, 1558 bp, Carnobacterium sp. 1290 CSPC
  ref <308>: DATABASE ACCESSION NUMBER: NCBI ACCESSION: NZ_JVVG01000115.1
  ref <309>: DATABASE ENTRY DATE: 2019-04-01
  ref <313>: RELEVANT RESIDUES IN SEQ ID NO: (1)..(1558)
tttcatgagagtttgatcctggctcaggacgaacgctggcggcatgcctaatacatgcaagtcgagcgaacagatgaagtgcttgcacttctgacgttagcggcgaacgggtgagtaacacgtaaggaatctacctataagcgggggataacattcggaaacgggtgctaataccgcataatatcttcttccgcatggaagaagattgaaagacggctctgctgtcacttatagatgaccttgcggtgcattagttagttggtggggtaacggcctaccaagacgatgatgcatagccgacctgagagggtgatcggccacattgggactgagacacggcccaaactcctacgggaggcagcagtagggaatcttccgcaatgggcgaaagcctgacggagcaatgccgcgtgagtgaagaaggccttcgggtcgtaaaactctgttataagagaagaacaaattgtagagtaactgctacagtcttgacggtatcttatcagaaagccacggctaactacgtgccagcagccgcggtaatacgtaggtggcaagcgttgtccggatttattgggcgtaaagggagcgcaggtggtttcttaagtctgatgtgaaagcccacggcttaaccgtggagggtcattggaaactgggaaacttgagtacagaagaggaatgtggaactccatgtgtagcggtggaatgcgtagatatatggaagaacaccagtggcgaaggcgacattctggtctgttactgacactgaggctcgaaagcgtggggagcaaacaggattagataccctggtagtccacgccgtaaacgatgagtgctaggtgttggagggtttccgcccttcagtgccgcagttaacgcattaagcactccgcctggggagtacgaccgcaaggttgaaactcaaaggaattgacggggacccgcacaagcggtggagcatgtggtttaattcgaagcaacgcgaagaaccttaccaagtcttgacatcctttgaccaccctagagatagggctttcccttcggggacaaagtgacaggtggtgcatggttgtcgtcagctcgtgtcgtgagatgttgggttaagtcccgcaacgagcgcaacccctattattagttgccagcattcagttgggcactctaatgagactgccggtgacaaaccggaggaaggtggggatgacgtcaaatcagcatgccccttatgacttgggctacacacgtgctacaatggatggtacaacgagtcgcaaacccgcgagggcaagcaaatctcttaaagccattctcagttcggattgcaggctgcaactcgcctgcatgaagccggaatcgctagtaatcgtggatcagcacgccacggtgaatacgttcccgggtcttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctcctttctaaggaa

SEQ ID NO: 2519 - DNA, 1573 bp, Carnobacterium sp. 17-4
  ref <308>: DATABASE ACCESSION NUMBER: NCBI ACCESSION: NC_015391.1
  ref <309>: DATABASE ENTRY DATE: 2019-04-01
  ref <313>: RELEVANT RESIDUES IN SEQ ID NO: (1)..(1573)
attttatatgagagtttgatcctggctcaggacgaacgctggcggcatgcctaatacatgcaagtcgaacgctttgatttcaccgggtgcttgcacccaccgaagtcaaagagtggcggacgggtgagtaacacgtgggtaacctgcccataagtgggggataacattcggaaacggatgctaataccgcatacttctaatcgcctcctggcgaatggaaaaaaggtggcttcggctaccgcttatggatggacccgcggcgtattagctagttggtgaggtaatggctcaccaaggcgatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggaaggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgatcaccctagagatagggctttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2520 - DNA, 1573 bp, Carnobacterium sp. AT7
  ref <308>: DATABASE ACCESSION NUMBER: NCBI ACCESSION: NZ_ABHH01000023.1
  ref <309>: DATABASE ENTRY DATE: 2019-04-01
  ref <313>: RELEVANT RESIDUES IN SEQ ID NO: (1)..(1573)
attttatatgagagtttgatcctggctcaggacgaacgctggcggcatgcctaatacatgcaagtcgaacgctttaacttcaccgggtgcttgcacccatcgaagttaaggagtggcggacgggtgagtaacacgtgggtaacctgcccataagagggggataacattcggaaacggatgctaataccgcatatttctaatcgtctcctgacgaatggaagaaaggtggcttcggctaccgcttatggatggacccgcggcgtattagctagttggtgaggtaatggctcaccaaggcgatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgacaatcctagagataggactttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcgaggtcgcgaggccaagctaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2521 - DNA, 1570 bp, Carnobacterium sp. CP1
  ref <308>: DATABASE ACCESSION NUMBER: NCBI ACCESSION: NZ_CP010796.1
  ref <309>: DATABASE ENTRY DATE: 2019-04-01
  ref <313>: RELEVANT RESIDUES IN SEQ ID NO: (1)..(1570)
ttttatgagagtttgatcctggctcaggacgaacgctggcggcatgcctaatacatgcaagtcgaacgcttcttttctaccgggtgcttgcacccaccagagaagaagagtggcggacgggtgagtaacacgtgggtaacctgcccataagtgggggataacagccggaaacggctgctaataccgcataattccagtgatctcctgatcgttggatgaaaggtggcttcggctaccgcttatggatggacccgcggcgtattagctagttggtgaggtaatggctcaccaaggcaatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccagctcaactggggaaggtcattggaaactggggaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattactagttgccagcattcagttgggcactctagtgagactgccggtgataaaccggaggaaggtggggatgacgtcaaatcatcatgccccttatgacctgggctacacacgtgctacaatggatggtacaacgagtcgcaagaccgcgaggtcaagctaatctcttaaagccattctcagttcggattgcaggctgcaactcgcctgcatgaagccggaatcgctagtaatcgcggatcagaacgccgcggtgaatacgttcccgggtcttgtacacaccgcccgtcacaccacgagagtttgtaacacccgaagtcggtgaggtaacctgcaaaggagccagccgcctaaggtgggatagataattggggtgaagtcgtaacaaggtagccgtatcggaaggtgcggctggatcacctcctttctaaggaa

SEQ ID NO: 2522 - DNA, 1573 bp, Carnobacterium sp. WN1374
  ref <308>: DATABASE ACCESSION NUMBER: NCBI ACCESSION: NZ_JQNG01000002.1
  ref <309>: DATABASE ENTRY DATE: 2019-04-01
  ref <313>: RELEVANT RESIDUES IN SEQ ID NO: (1)..(1573)
attttatatgagagtttgatcctggctcaggacgaacgctggcggcatgcctaatacatgcaagtcgaacgctttgatttcaccgggtgcttgcacccaccgaagtcaaagagtggcggacgggtgagtaacacgtgggtaacctgcccataagagggggataacattcggaaacggatgctaataccgcatacttctaatcgcctcctggcgaatggaaaaaaggtggcttcggctaccgcttatggatggacccgcggcgtattagctagttggtgaggtaatggctcaccaaggcgatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2523 - DNA, 1573 bp, Carnobacterium viridans
  ref <308>: DATABASE ACCESSION NUMBER: NCBI ACCESSION: NZ_FNJW01000008.1
  ref <309>: DATABASE ENTRY DATE: 2019-04-01
  ref <313>: RELEVANT RESIDUES IN SEQ ID NO: (1)..(1573)
attttatatgagagtttgatcctggctcaggacgaacgctggcggcatgcctaatacatgcaagtcgaacgctttgatttcaccgggtgcttgcacccgccgaagtcaaagagtggcggacgggtgagtaacacgtgggtaacctgcccataagagggggataacattcggaaacggatgctaataccgcatacttctaatcgcctcctggcgaatggaaaaaaggtggcttcggctaccgcttatggatggacccgcggcgtattagctagttggtgaggtaatggctcaccaaggcgatgatacgtagccgacctgagagggtgatcggccacactgggactgagacacggcccagactcctacgggaggcagcagtagggaatcttccgcaatggacgaaagtctgacggagcaatgccgcgtgagtgaagaaggttttcggatcgtaaaactctgttgttagagaagaacaaggatgagagtaactgctcatcccctgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccacgtgtagcggtgaaatgcgtagatatgtggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccctattattagttgccagcattcagttgggcactctagtgagactgccggtgataaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccgaagtcggtgaggtaacccttttgggagccagccgcctaaggtgggacagataattggggtgaagtcgtaacaaggtagccgtatcggaaggtgcggctggatcacctcctttctaaggaa

SEQ ID NO: 2524 - DNA, 1563 bp, Caryophanon latum
  ref <308>: DATABASE ACCESSION NUMBER: NCBI ACCESSION: NZ_MATO01000051.1
  ref <309>: DATABASE ENTRY DATE: 2019-04-01
  ref <313>: RELEVANT RESIDUES IN SEQ ID NO: (1)..(1563)
ttttatggagagtttgatcctggctcaggacgaacgctggcggcgtgcctaatacatgcaagtcgagcgaagacttcatcggtacttgtacctttgaatttttagcggcggacgggtgagtaacacgtgggtaacctaccttatagtttgggataactccgggaaaccggggctaataccgaataagtgatttcttcgcatgaagtgaatctggaaagacggtttcggctgtcgctataggatggacccgcggcgcattagctagttggtgaggtaacggctcaccaaggcaacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgtaagggaagaataagtagcgtagtaactggcgttaccttgacggtaccttattagaaagccacggctaactacgtgccagcagccgcggtaatacgtaggtggcaagcgttgtccggaattattgggcgtaaagcgcgcgcaggtggttctttaagtctgatgtgaaagcccccggctcaaccggggagggtcattggaaactggggaacttgagtgcagaagaggatagtggaattccaagtgtagcggtgaaatgcgtagagatttggaggaacaccagtggcgaaggcgactgtctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctatggagacatagctttcccttcggggacagtggtgacaggtggtgcatggttgtcgtcagctcgtgtcgtgagatgttgggttaagtcccgcaacgagcgcaacccttgtccttagttgccatcatttagttgggcactctagggagactgccggtgacaaaccggaggaaggtggggatgacgtcaaatcatcatgccccttatgacctgggctacacacgtgctacaatggacgatacaaacggttgccaacccgcgagggggagccaatccgataaagtcgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagccggtggggtaacccttttgggagctagccgtcgaaggtgggatagatgattggggtgaagtcgtaacaaggtagccgtatcggaaggtgcggctggatcacctcctttcta

SEQ ID NO: 2525 - DNA, 1561 bp, Caryophanon tenue
  ref <308>: DATABASE ACCESSION NUMBER: NCBI ACCESSION: NZ_MASJ01000025.1
  ref <309>: DATABASE ENTRY DATE: 2019-04-01
  ref <313>: RELEVANT RESIDUES IN SEQ ID NO: (1)..(1561)
tttttggagagtttgatcctggctcaggacgaacgctggcggcgtgcctaatacatgcaagtcgagcgaactgacttgagaagcttgcttctcaatgacgttagcggcggacgggtgagtaacacgtgggtaacctaccctatagactgggataacttcgggaaaccggagctaataccggataattgttttcttcgcatgaagagaattggaaagacggtttcggctgtcactataggatggacccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggatttcggttcgtaaaactctgttgcaagggaagaacaagtagcgtagtaactggcgctaccttgacggtaccttgttagaaagccacggctaactacgtgccagcagccgcggtaatacgtaggtggcaagcgttgtccggaattattgggcgtaaagcgcgcgcaggtggttctttaagtctgatgtgaaagcccccggctcaaccggggagggtcattggaaactggggaacttgagtgcagaagaggatagtggaattccaagtgtagcggtgaaatgcgtagagatttggaggaacaccagtggcgaaggcgactatctggtctgtaactgacactgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgaccactatggagacatagttttcccttcggggacaacggtgacaggtggtgcatggttgtcgtcagctcgtgtcgtgagatgttgggttaagtcccgcaacgagcgcaacccttgtccttagttgccagcatttagttgggcactctagggagactgccggtgacaaaccggaggaaggtggggatgacgtcaaatcatcatgccccttatgacctgggctacacacgtgctacaatggacggtacaaacggttgccaacccgcgagggggagccaatccgataaagccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagccggtggggtaacctttatggagccagccgtcgaaggtgggatagatgattggggtgaagtcgtaacaaggtagccgtatcggaaggtgcggctggatcacctcctttctaa

SEQ ID NO: 2526 - DNA, 405 bp, Catabacter hongkongensis
  ref <308>: DATABASE ACCESSION NUMBER: NCBI ACCESSION: NZ_LLYX01000073.1
  ref <309>: DATABASE ENTRY DATE: 2019-04-01
  ref <313>: RELEVANT RESIDUES IN SEQ ID NO: (1)..(405)
tttaattaagagtttgatcctggctcaggacgaacgctggcggcgtgcttaacacatgcaagtcgaacgaagttgctctttgggaagccctcgggtggaactgtgagtatacttagtggcggacgggtgagtaacgcgtgagcaatctgccctgcaatgggggacaacagttggaaacgactgctaataccgcataagaccacgaaaccgcatggtttagaggtaaaaggattcattcgatgcaggatgagctcgcgtcccattagatagttggtgaggtaacggcccaccaagtcaacgatgggtagccgacctgagagggtgatcggccacattggaactgagaaacggtccaaactcctacgggaggcagcagtggggaatattgggcaatgggggaaaccc

SEQ ID NO: 2527 - DNA, 1524 bp, Catellatospora citrea
  ref <308>: DATABASE ACCESSION NUMBER: NCBI ACCESSION: NZ_RAPR01000001.1
  ref <309>: DATABASE ENTRY DATE: 2019-04-01
  ref <313>: RELEVANT RESIDUES IN SEQ ID NO: (1)..(1524)
ttggagagtttgatcctggctcaggacgaacgctggcggcgtgcttaacacatgcaagtcgagcggaaaggcctttcggggtactcgagcggcgaacgggtgagtaacacgtgagtaacctgcccctggctttgggataaccatcggaaacggtggctaataccgaatattcactgcggaccgcatggtctgttgtggaaagtttttcggctggggatgggctcgcggcctatcagcttgttggtggggtgatggcctaccaaggctttgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgaaagtgacggtacctgcagaagaagcgccggccaactacgtgccagcagccgcggtaagacgtagggcgcgagcgttgtccggatttattgggcgtaaagagctcgtaggcggcttgttgcgtcgtccgtgaaaacctggggctcaactccaggcttgcggtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggtttcctgcgccgtagctaacgcattaagcgccccgcctggggagtacggccgcaaggctaaaactcaaaggaattgacgggggcccgcacaagcggcggagcatgcggattaattcgatgcgacgcgaagaaccttacctgggtttgacatggccgttaaagccgtagagatacggtgtccttcgggggcggtcacaggtggtgcatggctgtcgtcagctcgtgtcgtgagatgttgggttaagtcccgcaacgagcgcaaccctcgttccatgttgccagcgggtaatgccggggactcatgggagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagcccatggcccaacccgtaagggagggagtggtcgaaggtggggctggcgattgggacgaagtcgtaacaaggtagccgtaccggaaggtgcggctggatcacctcctttctaaggagca

SEQ ID NO: 2528 - DNA, 1567 bp, Catellicoccus marimammalium
  ref <308>: DATABASE ACCESSION NUMBER: NCBI ACCESSION: NZ_AMYT01000015.1
  ref <309>: DATABASE ENTRY DATE: 2019-04-01
  ref <313>: RELEVANT RESIDUES IN SEQ ID NO: (1)..(1567)
tttttatgagagtttgatcctggctcaggacgaacgctggcggcgtgcctaatacatgcaagtcgaacgcaaaacttttaactgatgcttgcatcgacctaaagttttgagtggcggacgggtgagtaacacgtgggtaacctgcccatcagagggggacaacacttggaaacaggtgctaataccgcataatacagagaaccgcatggttctttgttgaaaggcgcttctggtgtcgctgatggatggacccgcggtgcattagctagacggtgaggtaacggctcaccgtggcaatgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaggagcgatagtaactgctcgctctttgacggtatctaaccagaaagccacggctaactacgtgccagcagccgcggtaatacgtaggtggcaagcgttgtccggatttattgggcgtaaagcgagcgcaggcggtcttttaagtctgatgtgaaagcccacggcttaaccgtggagggtcattggaaactgggagacttgagtgcagaagaggaaagtggaactccatgtgtagcggtggaatgcgtagatatatggaagaacaccagtggcgaaggcggctttctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgtcgttagttgccatcattcagttgggcactctagcgagactgccggtgacaaaccggaggaaggtggggatgacgtcaaatcatcatgccccttatgacctgggctacacacgtgctacaatggacggtacaacgagcagcgaactcgcgagggcaagcgaatctcttaaagccgttctcagttcggattgcaggctgcaactcgcctgcatgaagccggaatcgctagtaatcgtggatcagcatgccacggtgaatacgttcccgggccttgtacacaccgcccgtcacaccacgagagtttgtaacacccaaagtcggtgcggtaaccttttggagccagccgcctaaggtgggatagatgattggggtgaagtcgtaacaaggtagccgtatcggaaggtgcggctggatcacctcctttctaagga

SEQ ID NO: 2529 - DNA, 1534 bp, Catenibacterium sp. AM22-6LB
  ref <308>: DATABASE ACCESSION NUMBER: NCBI ACCESSION: NZ_QTUM01000006.1
  ref <309>: DATABASE ENTRY DATE: 2019-04-01
  ref <313>: RELEVANT RESIDUES IN SEQ ID NO: (1)..(1534)
tggagagtttgatcctggctcaggatgaacgctggcggcgtgcctaatacatgcaagtcgaacgaatctcttttagagatgagtggcgaacgggtgagtaatacataggtaacctgcccctgtgcgggggataacaggaggaaactcctgctaataccgcatagccatgagcaccgcatggagctcatgccaaatatcctttcggggatagcgcagggatggacctatggcgcattagctggttggcggggcaacggcccaccaaggcaacgatgcgtagccggcctgagagggcggacggccacattgggactgagacacggcccagactcctacgggaggcagcagtagggaattttcggcaatgggggaaaccctgaccgagcaacgccgcgtgagcgaagaaggccttcgggtcgtaaagctctgttgtaaaggaagaacggcgcatacaggaaatggtatgcgagtgacggtactttaccagaaagccacggctaactacgtgccagcagccgcggtaatacgtaggtggcgagcgttatccggaatcattgggcgtaaagagggagcaggcggccgcaagggtctgtggtgaaagaccgaagctaaacttcggtaagccatggaaaccaggcggctagagtgcggaagaggatcgtggaattccatgtgtagcggtgaaatgcgtagatatatggaggaacaccagtggcgaaggcgacggtctgggccgcaactgacgctcattcccgaaagcgtggggagcaaataggattagataccctagtagtccacgccgtaaacgatggtcactaagtgtcgggggtcaaaccccggtgctgcagtcaacgcaataagtgacccgcctgagtagtacgttcgcaagaatgaaactcaaaggaattgacgggggcccgcacaagcggtggagcatgtggtttaattcgaagcaacgcgaagaaccttaccaggtcttgacatcgatctaaaagggatggagacatcctcatagctatagagaagacaggtggtgcatggttgtcgtcagctcgtgtcgtgagatgttgggttaagtcccgcaacgagcgcaacccctgtcgccagttaccatcattaagttggggactctggcgagactgcctctgcaaggaggaggaaggcggggatgacgtcaaatcatcatgccccttatgacctgggccacacacgtgctacaatggacgggacagagggaagcgaaggcgcgagccggagcggaccccagaaacccgttcccagttcggactgcagtctgcaactcgactgcacgaagccggaatcgctagtaatcgcggatcagcatgccgcggtgaatacgttctcgggccttgtacacaccgcccgtcacaccatgagagttggcaacacccgaagccggcggcccaacccgcaagggagggagctgtctaaggtggggctgatgattggggtgaagtcgtaacaaggtatccctacgggaacgtggggatggatcacctcctttctagggaga

SEQ ID NO: 2530 - DNA, 1535 bp, Catenibacterium sp. co 0103
  ref <308>: DATABASE ACCESSION NUMBER: NCBI ACCESSION: NZ_RCYB01000121.1
  ref <309>: DATABASE ENTRY DATE: 2019-04-01
  ref <313>: RELEVANT RESIDUES IN SEQ ID NO: (1)..(1535)
tggagagtttgatcctggctcaggatgaacgctggcggcgtgcctaatacatgcaagtcgaacgaatcttcttcggaagatgagtggcgaacgggtgagtaatacataggtaacctgcccctgtgcgggggataacaggaggaaactcctgctaataccgcatagccatgagcaccgcatggagctcatgccaaatatcctttcggggatagcgcagggatggacctatggcgcattagctagttggcggggcaacggcccaccaaggcaacgatgcgtagccggcctgagagggcggacggccacattgggactgagacacggcccagactcctacgggaggcagcagtagggaattttcggcaatgggggaaaccctgaccgagcaacgccgcgtgagcgaagaaggccttcgggtcgtaaagctctgttgtaaaggaagaacggcgcatacaggaaatggtatgcgagtgacggtactttaccagaaagccacggctaactacgtgccagcagccgcggtaatacgtaggtggcgagcgttatccggaatcattgggcgtaaagagggagcaggcggccgcaagggtctgtggtgaaagaccgaagctaaacttcggtaagccatggaaaccgggcggctagagtgcggaagaggatcgtggaattccatgtgtagcggtgaaatgcgtagatatatggaggaacaccagtggcgaaggcgacggtctgggccgcaactgacgctcattcccgaaagcgtggggagcaaataggattagataccctagtagtccacgccgtaaacgatggtcactaagtgtcgggggtcaaaccccggtgctgcagtcaacgcaataagtgacccgcctgagtagtacgttcgcaagaatgaaactcaaaggaattgacgggggcccgcacaagcggtggagcatgtggtttaattcgaagcaacgcgaagaaccttaccaggtcttgacatcgatctaaaagggatggagacatcctcatagctatagagaagacaggtggtgcatggttgtcgtcagctcgtgtcgtgagatgttgggttaagtcccgcaacgagcgcaacccctgtcgccagttaccatcattaagttggggactctggcgagactgcctctgcaaggaggaggaaggcggggatgacgtcaaatcatcatgccccttatgacctgggccacacacgtgctacaatggacgggacagagggaagcgaaggcgcgagccggagcggaccccagaaacccgttcccagttcggactgcagtctgcaactcgactgcacgaagccggaatcgctagtaatcgcggatcagaatgccgcggtgaatacgttctcgggccttgtacacaccgcccgtcacaccatgagagttggcaacacccgaagccggcggcccaacccgcaagggagggagctgtctaaggtggggctgatgattggggtgaagtcgtaacaaggtatccctacgggaacgtggggatggatcacctcctttctagggaga

SEQ ID NO: 2531 - DNA, 1488 bp, Caulobacter flavus
  ref <308>: DATABASE ACCESSION NUMBER: NCBI ACCESSION: NZ_CP026100.1
  ref <309>: DATABASE ENTRY DATE: 2019-04-01
  ref <313>: RELEVANT RESIDUES IN SEQ ID NO: (1)..(1488)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaagctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaaccctcgctgttagttgccaccattcagttgggcactctaacaggactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaag

SEQ ID NO: 2532 - DNA, 1491 bp, Caulobacter henricii
  ref <308>: DATABASE ACCESSION NUMBER: NCBI ACCESSION: NZ_CP013002.1
  ref <309>: DATABASE ENTRY DATE: 2019-04-01
  ref <313>: RELEVANT RESIDUES IN SEQ ID NO: (1)..(1491)
tcaacctgagagtttgatcctggctcagagcgaacgctggcggcaggcctaacacatgcaagtcgaacggatccttcgggattagtggcggacgggtgagtaacacgtgggaacgtgccttttggttcggaacaactcagggaaacttgagctaataccggataagcccttcgggggaaagatttatcgccattagagcggcccgcgtaggattagctagttggtggggtaaaggctcaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccacagagatgtggttttcccttcggggactgggacacaggtgctgcatggctgtcgtcagctcgtgtcgtgagatgttgggttaagtcccgcaacgagcgcaaccctcgctattagttgccatcaggtttggctgggcactctaataggaccgccggtggtaagccggaggaaggtggggatgacgtcaagtcctcatggcccttacaaggtgggctacacacgtgctacaatggcgactacagagggctgcaatcccgcgagggggagccaatccctaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctctacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 2533 - DNA, 1485 bp, Caulobacter mirabilis
  ref <308>: DATABASE ACCESSION NUMBER: NCBI ACCESSION: NZ_CP024201.1
  ref <309>: DATABASE ENTRY DATE: 2019-04-01
  ref <313>: RELEVANT RESIDUES IN SEQ ID NO: (1)..(1485)
caacctgagagtttgatcctggctcagagcgaacgctggcggcaggcctaacacatgcaagtcgaacgatccttcgggatagtggcggacgggtgagtaacacgtgggaacgtgccctttggttcggaacaactcagggaaacttgagctaataccgaatgtgcccttcgggggaaagatttatcgccattggagcggcccgcgtctgattagctagttggtgaggtaaaggctcaccaaggctacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggcgcgtaggcggacagtttagtcagaggtgaaagcccagggctcaaccttggaattgcctttgatactggctgtcttgagtacggaagaggtgtgtggaactccgagtgtagaggtgaaattcgtagatattcggaagaacaccagtggcgaaggcgacacactggtccgttactgacgctgaggcgcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggaccgctgcagagatgcagttttcccttcggggaccaggacacaggtgctgcatggctgtcgtcagctcgtgtcgtgagatgttgggttaagtcccgcaacgagcgcaacccacgccattagttgccatcatttagttgggcactctaatgggaccgccggtggtaagccggaggaaggtgtggatgacgtcaagtcctcatggcccttacagggtgggctacacacgtgctacaatggcgactacagagggctgcaagccagcgatggtgagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccgtaggggaacctgcggctggatcacctcctttctaag

SEQ ID NO: 2534 - DNA, 1488 bp, Caulobacter radicis
  ref <308>: DATABASE ACCESSION NUMBER: NCBI ACCESSION: NZ_QDKO01000035.1
  ref <309>: DATABASE ENTRY DATE: 2019-04-01
  ref <313>: RELEVANT RESIDUES IN SEQ ID NO: (1)..(1488)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaaccctcgctgttagttgccaccattcagttgggcactctaacaggactgccggagttaatccggaggaaggcggggatgacgtcaagtcctcatggcccttacaaggtgggctacacacgtgctacaatggcgactacagagggttgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaag

SEQ ID NO: 2535 - DNA, 1490 bp, Caulobacter segnis
  ref <308>: DATABASE ACCESSION NUMBER: NCBI ACCESSION: NZ_CP027850.1
  ref <309>: DATABASE ENTRY DATE: 2019-04-01
  ref <313>: RELEVANT RESIDUES IN SEQ ID NO: (1)..(1490)
caacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccacagagatgtggctttcccttcggggactgggacacaggtgctgcatggctgtcgtcagctcgtgtcgtgagatgttgggttaagtcccgcaacgagcgcaaccctcgcgattagttgccatcaggtttggctgggcactctaatcgtactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 2536 - DNA, 1490 bp, Caulobacter sp. 602-1
  ref <308>: DATABASE ACCESSION NUMBER: NCBI ACCESSION: NZ_RRYI01000015.1
  ref <309>: DATABASE ENTRY DATE: 2019-04-01
  ref <313>: RELEVANT RESIDUES IN SEQ ID NO: (1)..(1490)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtggggtaaaggcccaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaaccctcgcgattagttgccatcaggtttggctgggcactctaatcgtactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaag

SEQ ID NO: 2537 - DNA, 1488 bp, Caulobacter sp. 774
  ref <308>: DATABASE ACCESSION NUMBER: NCBI ACCESSION: NZ_QDKQ01000075.1
  ref <309>: DATABASE ENTRY DATE: 2019-04-01
  ref <313>: RELEVANT RESIDUES IN SEQ ID NO: (1)..(1488)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaaccctcgctgttagttgccaccattcagttgggcactctaacaggactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaag

SEQ ID NO: 2538 - DNA, 1495 bp, Caulobacter sp. CCH5-E12
  ref <308>: DATABASE ACCESSION NUMBER: NCBI ACCESSION: NZ_LSJD01000275.1
  ref <309>: DATABASE ENTRY DATE: 2019-04-01
  ref <313>: RELEVANT RESIDUES IN SEQ ID NO: (1)..(1495)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggaccgccacagagatgtggttttcccttcggggactgggacacaggtgctgcatggctgtcgtcagctcgtgtcgtgagatgttgggttaagtcccgcaacgagcgcaaccctcgcgattagttgccatcaggtttggctgggcactctaatcgtactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaagggggcaggcgaccacggtagggtcagcgactggggtgaagtcgtaacaaggtagccgtaggggaacctgcggctggatcacctcctttctaaggatgc

SEQ ID NO: 2539 - DNA, 1492 bp, Caulobacter sp. CCH9-E1
  ref <308>: DATABASE ACCESSION NUMBER: NCBI ACCESSION: NZ_LSJA01000371.1
  ref <309>: DATABASE ENTRY DATE: 2019-04-01
  ref <313>: RELEVANT RESIDUES IN SEQ ID NO: (1)..(1492)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtggggtaaaggcccaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccacagagatgtggctttcccttcggggactgggacacaggtgctgcatggctgtcgtcagctcgtgtcgtgagatgttgggttaagtcccgcaacgagcgcaaccctcgtgattagttgccatcaggtttggctgggcactctaatcatactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaagga

SEQ ID NO: 2540 - DNA, 1490 bp, Caulobacter sp. D5
  ref <308>: DATABASE ACCESSION NUMBER: NCBI ACCESSION: NZ_QHJY01000074.1
  ref <309>: DATABASE ENTRY DATE: 2019-04-01
  ref <313>: RELEVANT RESIDUES IN SEQ ID NO: (1)..(1490)
caacctgagagtttgatcctggctcagagcgaacgctggcggcaggcctaacacatgcaagtcgaacggatccttcgggattagtggcggacgggtgagtaacacgtgggaacgtgcactttggttcggaacaactcagggaaacttgagctaataccggatgtgcccttcgggggaaagatttatcgccattggagcggcccgcgtctgattagctagttggtgaggtaaaggctcaccaaggctacgatcagtagctggtctgagaggatgatcagccacattgggactgagacacggcccaaactcctacgggaggcagcagtggggaatcttgcgcattgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggacatccggagagatccggctttcccttcggggactgggacacaggtgctgcatggctgtcgtcagctcgtgtcgtgagatgttgggttaagtcccgcaacgagcgcaaccctcgctgttagttgccatcattaagttgggcactctaacaggactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaactcgcaagagaggcaggcgaccacggtagggtcagcgactggggggaagtcgtaacaaggtagccgtaggggaacctgcggctggatcacctcctttctaagg

SEQ ID NO: 2541 - DNA, 1493 bp, Caulobacter sp. FWC2
  ref <308>: DATABASE ACCESSION NUMBER: NCBI ACCESSION: NZ_PEBF01000001.1
  ref <309>: DATABASE ENTRY DATE: 2019-04-01
  ref <313>: RELEVANT RESIDUES IN SEQ ID NO: (1)..(1493)
tcaacctgagagtttgatcctggctcagagcgaacgctggcggcaggcctaacacatgcaagtcgaacggatccttcgggattagtggcggacgggtgagtaacacgtgggaacgtgccttttggttcggaacaactcagggaaacttgagctaataccggataagcccttcgggggaaagatttatcgccattagagcggcccgcgtaggattagctagttggtggggtaaaggcccaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaaccctcgcgattagttgccatcaggtttggctgggcactctaatcgtactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaactcgcaagagaggcaggcgaccacggtagggtcagcgactggggtgaagtcgtaacaaggtagccgtaggggaacctgcggctggatcacctcctttctaagg

SEQ ID NO: 2542 - DNA, 1490 bp, Caulobacter sp. FWC26
  ref <308>: DATABASE ACCESSION NUMBER: NCBI ACCESSION: NZ_CP033875.1
  ref <309>: DATABASE ENTRY DATE: 2019-04-01
  ref <313>: RELEVANT RESIDUES IN SEQ ID NO: (1)..(1490)
caacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggaccgccacagagatgtggttttcccttcggggactgggacacaggtgctgcatggctgtcgtcagctcgtgtcgtgagatgttgggttaagtcccgcaacgagcgcaaccctcgcgattagttgccatcaggtttggctgggcactctaatcgtactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 2543 - DNA, 1492 bp, Caulobacter sp. HMWF009
  ref <308>: DATABASE ACCESSION NUMBER: NCBI ACCESSION: NZ_QAIR01000217.1
  ref <309>: DATABASE ENTRY DATE: 2019-04-01
  ref <313>: RELEVANT RESIDUES IN SEQ ID NO: (1)..(1492)
caacctgagagtttgatcctggctcagagcgaacgctggcggcaggcctaacacatgcaagtcgaacggatccttcgggattagtggcggacgggtgagtaacacgtgggaacgtgccttttggttcggaacaactcagggaaacttgagctaataccggataagcccttcgggggaaagatttatcgccattagagcggcccgcgtaggattagctagttggtggggtaaaggcccaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccacagagatgtggttttcccttcggggactgggacacaggtgctgcatggctgtcgtcagctcgtgtcgtgagatgttgggttaagtcccgcaacgagcgcaaccctcgcgattagttgccatcaggtttggctgggcactctaatcgtactgccggagttaatccggaggaaggcggggatgacgtcaagtcctcatggcccttacaaggtgggctacacacgtgctacaatggcgactacagagggctgcaatcccgcgagggggagccaatcctaaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctttacccgaaggcgctgcgctaactcgcaagagaggcaggcgaccacggtagggtcagcgactggggtgaagtcgtaacaaggtagccgtaggggaacctgcggctggatcacctcctttctaagg

SEQ ID NO: 2544 - DNA, 1492 bp, Caulobacter sp. HMWF025; identical to SEQ ID NO: 2543
  ref <308>: DATABASE ACCESSION NUMBER: NCBI ACCESSION: NZ_QAII01000160.1
  ref <309>: DATABASE ENTRY DATE: 2019-04-01
  ref <313>: RELEVANT RESIDUES IN SEQ ID NO: (1)..(1492)

SEQ ID NO: 2545 - DNA, 1494 bp, Caulobacter sp. K31
  ref <308>: DATABASE ACCESSION NUMBER: NCBI ACCESSION: NC_010338.1
  ref <309>: DATABASE ENTRY DATE: 2019-04-01
  ref <313>: RELEVANT RESIDUES IN SEQ ID NO: (1)..(1494)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggataagcctttcgagggaaagatttatcgccattggagcggcccgcgtaggattagctagttggtggggtaaaggcccaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggccggcatgccggtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgcctcagagatgaggctttcccttcggggactgggacacaggtgctgcatggctgtcgtcagctcgtgtcgtgagatgttgggttaagtcccgcaacgagcgcaaccctcgctattagttgccatcaggtttggctgggcactctaataggaccgccggtggtaagccggaggaaggtggggatgacgtcaagtcctcatggcccttacaaggtgggctacacacgtgctacaatggcgactacagagggctgcaatcccgcgagggggagccaatccctaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctctacccgaaggcgctgcgctaacccgcaagggaggtaggcgaccacggtagggtcagcgactggggtgaagtcgtaacaaggtagccgtaggggaacctgcggctggatcacctcctttctaagga

SEQ ID NO: 2546 - DNA, 1497 bp, Caulobacter sp. OV484
  ref <308>: DATABASE ACCESSION NUMBER: NCBI ACCESSION: NZ_JUGJ01000007.1
  ref <309>: DATABASE ENTRY DATE: 2019-04-01
  ref <313>: RELEVANT RESIDUES IN SEQ ID NO: (1)..(1497)
tcaacctgagagtttgatcctggctcagagcgaacgctggcggcaggcctaacacatgcaagtcgaacggatccttcgggattagtggcggacgggtgagtaacacgtgggaacgtgccttttggttcggaacaactcagggaaacttgagctaataccggataagcccttcgggggaaagatttatcgccattagagcggcccgcgtctgattagctagttggtggggtaaaggcccaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaaccctcgcgattagttgccatcaggtttggctgggcactctaatcgtactgccggagttaatccggaggaaggcggggatgacgtcaagtcctcatggcccttacaaggtgggctacacacgtgctacaatggcgactacagagggttgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaactcgcaagagaggcaggcgaccacggtagggtcagcgactggggtgaagtcgtaacaaggtagccgtaggggaacctgcggctggatcacctcctttctaaggatgc

SEQ ID NO: 2547 - DNA, 1494 bp, Caulobacter sp. Root1455
  ref <308>: DATABASE ACCESSION NUMBER: NCBI ACCESSION: NZ_LMFQ01000007.1
  ref <309>: DATABASE ENTRY DATE: 2019-04-01
  ref <313>: RELEVANT RESIDUES IN SEQ ID NO: (1)..(1494)
tcaacctgagagtttgatcctggctcagagcgaacgctggcggcaggcctaacacatgcaagtcgaacggatccttcgggattagtggcggacgggtgagtaacacgtgggaacgtgccttttggttcggaacaactcagggaaacttgagctaataccggataagcctttcgagggaaagatttatcgccattagagcggcccgcgtaggattagctagttggtggggtaaaggcccaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccagagagatctggctttcccttcggggactgggacacaggtgctgcatggctgtcgtcagctcgtgtcgtgagatgttgggttaagtcccgcaacgagcgcaaccctcgctattagttgccatcaggtttggctgggcactctaataggaccgccggtggtaagccggaggaaggtggggatgacgtcaagtcctcatggcccttacaaggtgggctacacacgtgctacaatggcgactacagagggctgcaatcccgcgagggggagccaatccctaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctttacccgaaggcgctgcgctaactcgcaagagaggcaggcgaccacggtagggtcagcgactggggtgaagtcgtaacaaggtagccgtaggggaacctgcggctggatcacctcctttctaagga

SEQ ID NO: 2548 - DNA, 1494 bp, Caulobacter sp. Root1472
  ref <308>: DATABASE ACCESSION NUMBER: NCBI ACCESSION: NZ_LMFX01000009.1
  ref <309>: DATABASE ENTRY DATE: 2019-04-01
  ref <313>: RELEVANT RESIDUES IN SEQ ID NO: (1)..(1494)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtaggattagctagttggtggggtaaaggcccaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccgcagagatgcggctttcccttcggggactgggacacaggtgctgcatggctgtcgtcagctcgtgtcgtgagatgttgggttaagtcccgcaacgagcgcaaccctcgctattagttgccatcaggtttggctgggcactctaatagtactgccgaagttaattcggaggaaggtggggatgacgtcaagtcctcatggcccttacaaggtgggctacacacgtgctacaatggcgactacagagggctgcaatcccgcgagggggagccaatccctaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctttacccgaaggcgctgcgctaactcgcaagagaggcaggcgaccacggtagggtcagcgactggggtgaagtcgtaacaaggtagccgtaggggaacctgcggctggatcacctcctttctaagga

SEQ ID NO: 2549 - DNA, 1061 bp, Caulobacter sp. Root342
  ref <308>: DATABASE ACCESSION NUMBER: NCBI ACCESSION: NZ_LMDD01000002.1
  ref <309>: DATABASE ENTRY DATE: 2019-04-01
  ref <313>: RELEVANT RESIDUES IN SEQ ID NO: (1)..(1061)
tcaacctgagagtttgatcctggctcagagcgaacgctggcggcaggcctaacacatgcaagtcgaacggatccttcgggattagtggcggacgggtgagtaacacgtgggaacgtgccttttggttcggaacaactcagggaaacttgagctaataccggataagcccttcgggggaaagatttatcgccattagagcggcccgcgtctgattagctagttggtggggtaaaggcccaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccaccagagagatctggctttcccttcggggactgggacacaggtgctgcatggctgtcgtcagctcgtgtcgtgagatgttgggttaagtcccgcaacgagcgcaaccctcgc

SEQ ID NO: 2550 - DNA, 1497 bp, Caulobacter sp. Root343; identical to SEQ ID NO: 2546
  ref <308>: DATABASE ACCESSION NUMBER: NCBI ACCESSION: NZ_LMDF01000001.1
  ref <309>: DATABASE ENTRY DATE: 2019-04-01
  ref <313>: RELEVANT RESIDUES IN SEQ ID NO: (1)..(1497)

SEQ ID NO: 2551 - DNA, 1494 bp, Caulobacter sp. Root487D2Y; identical to SEQ ID NO: 2547
  ref <308>: DATABASE ACCESSION NUMBER: NCBI ACCESSION: NZ_LMFD01000013.1
  ref <309>: DATABASE ENTRY DATE: 2019-04-01
  ref <313>: RELEVANT RESIDUES IN SEQ ID NO: (1)..(1494)

SEQ ID NO: 2552 - DNA, 1494 bp, Caulobacter sp. Root655
  ref <308>: DATABASE ACCESSION NUMBER: NCBI ACCESSION: NZ_LMHC01000001.1
  ref <309>: DATABASE ENTRY DATE: 2019-04-01
  ref <313>: RELEVANT RESIDUES IN SEQ ID NO: (1)..(1494)
tcaacctgagagtttgatcctggctcagagcgaacgctggcggcaggcctaacacatgcaagtcgaacggatccttcgggattagtggcggacgggtgagtaacacgtgggaacgtgccttttggttcggaacaactcagggaaacttgagctaataccggataagcctttcgagggaaagatttatcgccattagagcggcccgcgtaggattagctagttggtggggtaaaggcccaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccgcagagatgcggctttcccttcggggactgggacacaggtgctgcatggctgtcgtcagctcgtgtcgtgagatgttgggttaagtcccgcaacgagcgcaaccctcgctattagttgccatcaggtttggctgggcactctaataggaccgccggtggtaagccggaggaaggtggggatgacgtcaagtcctcatggcccttacaaggtgggctacacacgtgctacaatggcgactacagagggctgcaatcccgcgagggggagccaatccctaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctctacccgaaggcgctgcgctaacccgcaagggaggtaggcgaccacggtagggtcagcgactggggtgaagtcgtaacaaggtagccgtaggggaacctgcggctggatcacctcctttctaagga

SEQ ID NO: 2553 - DNA, 1492 bp, Caulobacter sp. UNC358MFTsu5.1
  ref <308>: DATABASE ACCESSION NUMBER: NCBI ACCESSION: NZ_JONW01000003.1
  ref <309>: DATABASE ENTRY DATE: 2019-04-01
  ref <313>: RELEVANT RESIDUES IN SEQ ID NO: (1)..(1492)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtaggattagctagttggtggggtaaaggcccaccaaggcgacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccgcagagatgcggctttcccttcggggactgggacacaggtgctgcatggctgtcgtcagctcgtgtcgtgagatgttgggttaagtcccgcaacgagcgcaaccctcgctattagttgccatcaggtttggctgggcactctaatagtactgccgaagttaattcggaggaaggtggggatgacgtcaagtcctcatggcccttacaaggtgggctacacacgtgctacaatggcgactacagagggctgcaatcccgcgagggggagccaatccctaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaagga

SEQ ID NO: 2554 - DNA, 1497 bp, Caulobacter sp. URHA0033
  ref <308>: DATABASE ACCESSION NUMBER: NCBI ACCESSION: NZ_AUEO01000023.1
  ref <309>: DATABASE ENTRY DATE: 2019-04-01
  ref <313>: RELEVANT RESIDUES IN SEQ ID NO: (1)..(1497)
tcaacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggataagcccttcgggggaaagatttatcgccattggagcggcccgcgtaggattagctagttggtggggtaaaggcccaccaaggctacgatccttagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgccgcagagatgcggctttcccttcggggactgggacacaggtgctgcatggctgtcgtcagctcgtgtcgtgagatgttgggttaagtcccgcaacgagcgcaaccctcgctattagttgccatcaggtttggctgggcactctaataggaccgccggtggtaagccggaggaaggtggggatgacgtcaagtcctcatggcccttacaaggtgggctacacacgtgctacaatggcgactacagagggctgcaatcccgcgagggggagccaatccctaaaagtcgtctcagttcggattgcactctgcaactcgagtgcatgaagttggaatcgctagtaatcgcggatcagcatgccgcggtgaatacgttcccgggccttgtacacaccgcccgtcacaccatgggagttggctttacccgaaggcgctgcgctaactcgcaagagaggcaggcgaccacggtagggtcagcgactggggtgaagtcgtaacaaggtagccgtaggggaacctgcggctggatcacctcctttctaaggatgc

SEQ ID NO: 2555 - DNA, 1490 bp, Caulobacter vibrioides
  ref <308>: DATABASE ACCESSION NUMBER: NCBI ACCESSION: NZ_CP034122.1
  ref <309>: DATABASE ENTRY DATE: 2019-04-01
  ref <313>: RELEVANT RESIDUES IN SEQ ID NO: (1)..(1490)
caacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgccgtaaacgatgagtgctagttgtcggcatgcatgcatgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggaccgccacagagatgtggttttcccttcggggactgggacacaggtgctgcatggctgtcgtcagctcgtgtcgtgagatgttgggttaagtcccgcaacgagcgcaaccctcgtgattagttgccatcaggtttggctgggcactctaatcatactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaagggggcaggcgaccacggtagggtcagcgactggggtgaagtcgtaacaaggtagccgtaggggaacctgcggctggatcacctcctttctaagg

SEQ ID NO: 2556 - DNA, 1487 bp, Caulobacter zeae
  ref <308>: DATABASE ACCESSION NUMBER: NCBI ACCESSION: NZ_PJRS01000035.1
  ref <309>: DATABASE ENTRY DATE: 2019-04-01
  ref <313>: RELEVANT RESIDUES IN SEQ ID NO: (1)..(1487)
caacctgagagtttgatcctggctcagagcgaacgctggcggcaggcctaacacatgcaagtcgaacggatccttcgggattagtggcggacgggtgagtaacacgtgggaacgtgccctttggttcggaacaactcagggaaacttgagctaataccggatgtgcccttcgggggaaagatttatcgccattggagcggcccgcgtctgattagctagttggtgaggtaaaggctcaccaaggcgacgatcagtagctggtctgagaggatgatcagccacattgggactgagacacggcccaaactcctacgggaggcagcagtggggaatcttgcgcaatgggcgaaagcctgacgcagccatgccgcgtgaatgatgaaggtcttaggattgtaaaattctttcaccggggacgataatgacggtacccggagaagaagccccggctaacttcgtgccagcagccgcggtaatacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacaggattagataccctggtagtccacgctgtaaacgatgagtgctagttgtcggcaggcatgcctgtcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcctggacatccagagagatctggctttcccttcggggactgggacacaggtgctgcatggctgtcgtcagctcgtgtcgtgagatgttgggttaagtcccgcaacgagcgcaaccctcgctgttagttgccaccattcagttgggcactctaacaggactgccggagttaatccggaggaaggcggggatgacgtcaagtcctcatggcccttacaaggtgggctacacacgtgctacaatggcgactacagagggctgcaatcccgcgagggggagccaatccctaaaagtcgtctcagttcggattgttctctgcaactcgagagcatgaagttggaatcgctagtaatcgcggatcagcatgccgcggtgaatacgttcccgggccttgtacacaccgcccgtcacaccatgggagttggctttacccgaaggcgctgcgctaaccgcaaggaggcaggcgaccacggtagggtcagcgactggggtgaagtcgtaacaaggtagccgtaggggaacctgcggctggatcacctcctttctaag

SEQ ID NO: 2557 - DNA, 1468 bp, Caulobacteraceae bacterium OTSz A 272
  ref <308>: DATABASE ACCESSION NUMBER: NCBI ACCESSION: NZ_CP013244.1
  ref <309>: DATABASE ENTRY DATE: 2019-04-01
  ref <313>: RELEVANT RESIDUES IN SEQ ID NO: (1)..(1468)
caacctgagagtttgattctggctcagaacgaacgctggcggcaggcttaacacatgcaagtcgaacgccccgcaaggggagtggcagacgggtgagtaacacgtgggaacatgcccaaaggtacggaatattctcgggaaactgggagcaataccgtatgtgcccgaaaggggaaagatttatcgcctttggattggcccgcgttggattagctagttggtggggtaaaagcctaccaaggcgacgatccatagctggtctgagaggacgaccagccacactgggactgagacacggcccagactcctacgggaggcagcagtggggaatcttggacaatgggcgcaagcctgatccagccatgccgcgtgagtgatgaaggccctagggttgtaaaactctttcgtgggggacgataatgacggtaccccaagaagaagctccggctaactacgtgccagcagccgcggtaatacgtagggggcaagcgttgttcggatttactgggcgtaaagcgcgtgtaggcgggctggaaagttgggggtgaaatcccggggctcaacctcggaactgcctccaaaacttccagcctggactcaagtagaggcaagtggaattgcgagtgtagaggtgaaattcgtagatattcgcaggaacaccagtggcgaaggcgacttgctggacttgtagtgacgctgagacgcgaaagcgtggggagcaaacaggattagataccctggtagtccacgctgtaaacgatgagagctagttgtcggcacgcatgcgtgtcggtgacgcagctaacgcattaagctctccgcctggggagtacggccgcaaggttaaaactcaaagaaattgacgggggcccgcacaagcggtggagcatgtggtttaattcgaagcaacgcgcagaaccttacccacgtttgacatgtctagtttgatcgtcagagatgactttcttcagttcggctggctagaacacaggtgctgcatggctgtcgtcagctcgtgtcgtgagatgttgggttaagtcccgcaacgagcgcaaccctcgctactagttgccatcacgttatggtgggcactctagtggaactgccggtggcaagccggaggaaggtggggatgacgtcaagtcctcatggcccttacgcgtggggctacacacgtgctacaatggtggtgacagagggataatccctaaaagccatctcagttcggattgtcctctgcaactcgagggcatgaagttggaatcgctagtaatcgcggatcagcatgccgcggtgaatacgttcccgggccttgtacacaccgcccgtcacaccatgggagttggttctacccgaaggcgctgcgctaaccgcaagggggcaggcgaccacggtagggtcagcgactggggtgaagtcgtaacaaggtagccgtaggggaacctgcggctggatcacctcctttcta

SEQ ID NO: 2558 - DNA, 1488 bp, Caulobacteraceae bacterium PMMR1
  ref <308>: DATABASE ACCESSION NUMBER: NCBI ACCESSION: NZ_JPOM01000001.1
  ref <309>: DATABASE ENTRY DATE: 2019-04-01
  ref <313>: RELEVANT RESIDUES IN SEQ ID NO: (1)..(1488)
tcaacctgagagtttgatcctggctcagagcgaacgctggcggcaggcttaacacatgcaagtcgaacggtccttcgggacagtggcggacgggtgagtaacacgtgggaacgtgcccttaggttcggaataactcagggaaacttgagctaataccggatgtgcccttacggggaaagatttatcgcctttggagcggcccgcgtctgattagctagttggtggggtaatggcctaccaaggcgacgatcagtagctggtctgagaggatggccagccacactgggactgagacacggcccagactcctacgggaggcagcagtggggaatcttgcgcaatgggggaaaccctgacgcagccatgccgcgtggatgatgaaggtcttaggatcgtaaaatcctttcagcggggacgataatgacggtacccgcagaagaagccccggctaacttcgtgccagcagccgcggtaatacgaagggggctagcgttgctcggatttactgggcgtaaagggcgcgtaggcggacagttaagtcgggggtgaaagcccggggctcaacctcggaattgccttcgatactggctgtcttgagtacgggagaggtgtgtggaactccgagtgtagaggtgaaattcgtagatattcggaagaacaccagtggcgaaggcgacacactggcccgttactgacgctgaggcgcgaaagcgtggggagcaaacaggattagataccctggtagtccacgccgtaaacgatgagtgctagttgtcgggcggcatgccgttcggtgacgcagctaacgcattaagcactccgcctggggagtacggtcgcaagattaaaactcaaaggaattgacgggggcccgcacaagcggtggagcatgtggtttaattcgaagcaacgcgcagaaccttaccaccttttgacatgcccggaccgcgtgagagatcacgctttccctccggggactgggacacaggtgctgcatggctgtcgtcagctcgtgtcgtgagatgttgggttaagtcccgcaacgagcgcaaccctcgctgttagttgccatcattcagttgggcactctagcaggactgccggagctaatccggaggaaggcggggatgacgtcaagtcctcatggcccttacggggtgggctacacacgtgctacaatggcgactacagagggctgcaaacccgcgagggggagccaatccctaaaagtcgtctcagttcggattgcactctgcaactcgagtgcatgaagctggaatcgctagtaatcgcggatcagcatgccgcggtgaatacgttcccgggccttgtacacaccgcccgtcacaccatgggagttggctttacccgaaggcgctgtgctaaccgcaaggaggcaggtgaccacggtagggtcagcgactggggtgaagtcgtaacaaggtagccgtaggggaacctgcggctggatcacctcctttctaagga

SEQ ID NO: 2559 - DNA, 1520 bp, Caviibacter abscessus
  ref <308>: DATABASE ACCESSION NUMBER: NCBI ACCESSION: NZ_LOQH01000134.1
  ref <309>: DATABASE ENTRY DATE: 2019-04-01
  ref <313>: RELEVANT RESIDUES IN SEQ ID NO: (1)..(1520)
gaatgaagagtttgatcctggctcaggataaacgctgacagaatgcttaacacatgcaagtcgatgatgggagtatagcctagctataaagaagtcatggcggacgggtgagtaacgtgtaaagaacttgccctctagactgggataacagatagaaatgtctgataatactggatattattacttactggcatcagtaagaaatgaaaggtggagacatgctagaggagagctttgcatcctattagctagttggtaaggtagcggcttaccaaggcgatgataggtagccggcctgagagggtggacggccacaaggggactgagatacggcccttactcctacgggaggcagcagtggggaatattggacaatggagggaactctgatccagcaattctgtgtgtgtgaagaaggtcttcggattgtaaaacacttttagttgggaagaagaagatgacggtaccaacagaagaagcgacggctaaatacgtgccagcagccgcggtaatacgtatgtcgcgagcgttatccggaattattgggcttaaagggcatctaggcggcataacaagttgaaggtgaaaaacttaggctcaaccaaagtcttgcctacaaaactgtaatgctagagtactggaaaggtgggtggaactacacgagtagaggtgaaattcgtagatatgtgtaggaatgccgatgatgaagataactcactggacagctactgacgctgaagtgcgaaagctaggggagcaaacaggattagataccctggtagtcctagctgtaaacgatgattactgggtgtggggatgagaagtctctgtgccgaagcaaaagcgataagtaatccgcctggggagtacgttcgcaagaatgaaactcaaaggaattgacgggggcccgcacaagtggtggagcatgtggtttaattcgacgcaacgcgaggaaccttaccagatcttgacatcctcgggaggttgtagaagtacgactgtgccttcgggaaccgagagacaggtggtgcatggctgtcgacagctcgtgttgtgagatgttgggttaagtcccgcaacgagcgaaacccctatcattagttgccatcattaagttggggactctaatgaaactgcctgcgaagagcaggaggaaggtggggatgacgtcaagtcatcatgccccttatgatctgggctacacacgtgctacaatgggtagtacaaagagaagcgaaatggcgacatggagcaaaactagaaagctactctaagttcggattgaagtctgcaactcgacttcatgaagttggaatcactagtaatcgcaaatcagcaatgttgcggtgaatacgttctcgggccttgtacacaccgcccgtcacaccacgagagttgtttgcacctgaaattattggtctaaccgagagggggaagataatgaaggtgtgaatagtgattggggtgaagtcgtaacaaggtatccgtaccggaaggtgcggatggatcacctcctttct

SEQ ID NO: 2560 - DNA, 1525 bp, Cecembia lonarensis
  ref <308>: DATABASE ACCESSION NUMBER: NCBI ACCESSION: NZ_AMGM01000182.1
  ref <309>: DATABASE ENTRY DATE: 2019-04-01
  ref <313>: RELEVANT RESIDUES IN SEQ ID NO: (1)..(1525)
tttacaatggagagtttgatcctggctcaggatgaacgctagcggcaggcctaatacatgcaagtcggacggtagagattctttcggggatcttgagagtggcgcacgggtgcgtaacgcgtatgcaacctgccttttaccgggggatagcccggggaaacccggattaataccccatggtattgagagatggcatcatcgttcaattaaagatttatcggtagaagatgggcatgcgtaggattagctagttggcggggtaacggcccaccaaggcgatgatccttaggggttctgagaggaaggtcccccacactggcactgagatacgggccagactcctacgggaggcagcagtagggaatattgggcaatggtcggaagactgacccagccatgccgcgtgcaggaagaaggcgttacgcgttgtaaactgcttttatacgggaagaaaaagcaactgcggttgaaattgccggtaccgtatgaataagcaccggctaactccgtgccagcagccgcggtaatacggagggtgcgagcgttgtccggatttattgggtttaaagggtgcgcaggcggcctgataagtcagcggtgaaatactccggctcaaccggaggggtgccgttgatactgtttggcttgagtgcggtctacgtacatggaatttatggtgtagcggtgaaatgcatagataccataaggaacaccgatagcgaaggcattgtacggggccgtaactgacgctgaggcacgaaagcgtgggtagcgaacaggattagataccctggtagtccacgccgtaaacgatgatcactcgctgttatcctgttaaggggtagtggccaagcgaaagcgttaagtgatccacctggggagtacgccggcaacggtgaaactcaaaggaattgacgggggtccgcacaagcggtggagcatgtggtttaattcgatgatacgcgaggaaccttacctgggctagaatgtgaaggaatgatatagagatgtatcagtctgcaaagacctgaaacaaggtgctgcatggctgtcgtcagctcgtgccgtgaggtgttgggttaagtcccgcaacgagcgcaacccctgtgtccagttgccatcgagtaaagttggggactctggacagactgcctgcgcaagcagagaggaaggaggggacgacgtcaagtcatcatggcccttacgcccagggcgacacacgtgctacaatggcgcatacagcgggtagctacctggcaacaggatgccaacctctaaaagtgcgtctcagttcggattggggtctgcaacccgaccccatgaagctggaatcgctagtaatcgcgcatcagccatggcgcggtgaatacgttcccggaccttgtacacaccgcccgtcaagccatggaagtcgggtagacctgaagacggtaaccgcgaggagccgtttagggtagaaccggtaactggggctaagtcgtaacaaggtagccgtaccggaaggtgcggctggaacacctccttt

SEQ ID NO: 2561 - DNA, 1527 bp, Cecembia rubra
  ref <308>: DATABASE ACCESSION NUMBER: NCBI ACCESSION: NZ_PYGF01000025.1
  ref <309>: DATABASE ENTRY DATE: 2019-04-01
  ref <313>: RELEVANT RESIDUES IN SEQ ID NO: (1)..(1527)
tttacaatggagagtttgatcctggctcaggatgaacgctagcggcaggcctaatacatgcaagtcgtacggtagagattctttcggggatcttgagagtggcgcacgggtgcgtaacgcgtatgcaacctgccctgtactgggggatagcccggggaaacccggattaataccccatggtattgttggacggcatcgtccggcgattaaagatttatcggtacgggatgggcatgcgtaggattagctagttggcggggtaacggcccaccaaggcttcgatccttaggggttctgagaggaaggtcccccacactggcactgagatacgggccagactcctacgggaggcagcagtagggaatattgggcaatggtcggaagactgacccagccatgccgcgtgcaggaagaaggccttatgggttgtaaactgcttttatctgggaagaaaaagtccctgcggggaaaattgccggtaccagatgaataagcaccggctaactccgtgccagcagccgcggtaatacggagggtgcgagcgttgtccggatttattgggtttaaagggtgcgtaggcggccttataagtcagcggtgaaatacccaggctcaacctggggggtgccgttgatactgtatggcttgagtgcgttccgtgtacatggaatttatggtgtagcggtgaaatgcatagataccataaggaacaccgatagcgaaggcattgtacaggggcgtaactgacgctgaggcacgaaagcacgggtagcgaacaggattagataccctggtagtccgtgccgtaaacgatgatcactcgctgttgaccctatatgggtcagtggccaagcgaaagcgttaagtgatccacctggggagtacgccggcaacggtgaaactcaaaggaattgacgggggtccgcacaagcggtggagcatgtggtttaattcgatgatacgcgaggaaccttacctgggctagaatgtgaaggaatgatttggagacagatcagtcggcaacgacctgaaacaaggtgctgcatggctgtcgtcagctcgtgccgtgaggtgttgggttaagtcccgcaacgagcgcaacccctattgtcagttgccatcgggtagagccggggactctgacaagactgcctgcgcaagcagagaggaaggaggggacgacgtcaagtcatcatggcccttacgcccagggcgacacacgtgctacaatggcgcatacagcgggtagctacctggtgacaggatgccaacctctaaaagtgcgtctcagttcggattggggtctgcaacccgaccccatgaagctggaatcgctagtaatcgcgcatcagccatggcgcggtgaatacgttcccggaccttgtacacaccgcccgtcaagccatggaagtcgggtagacctgaaggcggtaaccgcgaggagccgtttagggtagaaccggtaactggggctaagtcgtaacaaggtagccgtaccggaaggtgcggctggaacacctcctttct

SEQ ID NO: 2562 - DNA, 1551 bp, Cedecea davisae
  ref <308>: DATABASE ACCESSION NUMBER: NCBI ACCESSION: NZ_UFVK01000003.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggtaacagggagtagcttgctactccgctgacgagcggcggacgggtgagtaatgtctggggatctgcctgatggagggggataactactggaaacggtagctaataccgcataacgtcgcaagaccaaagagggggaccttcgggcctcttgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaaga

SEQ ID NO: 2563 - DNA, 1551 bp, Cedecea lapagei
  ref <308>: DATABASE ACCESSION NUMBER: NCBI ACCESSION: NZ_LR134201.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggtagcacggggagcttgctcctgggtgacgagcggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggcccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaaga

SEQ ID NO: 2564 - DNA, 1553 bp, Cedecea neteri
  ref <308>: DATABASE ACCESSION NUMBER: NCBI ACCESSION: NZ_CP023525.1
  ref <309>: DATABASE ENTRY DATE: 2019-04-01
  ref <313>: RELEVANT RESIDUES IN SEQ ID NO: (1)..(1553)
ttaaattgaagagtttgatcatggctcagattgaacgctggcggcaggcctaacacatgcaagtcgagcggtagcacgggagagcttgctctctgggtgacgagcggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttggcgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccggggactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaaga

SEQ ID NO: 2565 - DNA, 1472 bp, Celeribacter baekdonensis
  ref <308>: DATABASE ACCESSION NUMBER: NCBI ACCESSION: NZ_FNBL01000004.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcacgcctaacacatgcaagtcgagcgggatcttcggatctagcggcggacgggttagtaacgcgtgggaacgtacccagatctacggaatagcctcgggaaactgagagtaataccgtatacgcccttcgggggaaagatttatcggatttggatcggcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagcgatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactagtcagtcagaggtgaaatcccagggctcaaccctggaactgcctttgatactgctagtcttgagttcgagagaggtaagtggaattccgagtgtagaggtgaaattcgtagatattcggaggaacaccagtggcgaaggcggcttactggctcgatactgacgctgaggtgcgaaagtgtggggagcaaacaggattagataccctggtagtccacaccgtaaacgatgaatgccagacgtcgggtagcatgctattcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggatcgtagagatactttccttcagttcggctggatcagtgacaggtgctgcatggctgtcgtcagctcgtgtcgtgagatgttcggttaagtccggcaacgagcgcaacccacatccttagttaccagcggtttggccggggactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcggccccatgaagtcggaatcgctagtaatcgcgtaacagcatgacgcggtgaatacgttcccgggccttgtacacaccgcccgtcacaccatgggagttgggtctacccgacggccgtgcgccaacctttcgaggaggcagcggaccacggtaggctcagcgactggggtgaagtcgtaacaaggtagccgtaggggaacctgcggctggatcacctcctttctaa

SEQ ID NO: 2566 - DNA, 1471 bp, Celeribacter ethanolicus
  ref <308>: DATABASE ACCESSION NUMBER: NCBI ACCESSION: NZ_CP022196.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaagccttcgggtttagcggcggacgggttagtaacgcgtgggaacgtacccttcactacggaatagtcccgggaaactgggtttaataccgtatacgccctttgggggaaagaatttcggtgagggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggggcaaccctgatctagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtaagtggaattccgagtgtagaggtgaaattcgtagatattcggaggaacaccagtggcgaaggcggcttactggctcgatactgacgctgaggtgcgaaagtgtggggagcaaacaggattagataccctggtagtccacaccgtaaacgatgaatgccagtcgtcggcaagtatacttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttacgagagatcgtttccttcagttcggctggatcagtgacaggtgctgcatggctgtcgtcagctcgtgtcgtgagatgttcggttaagtccggcaacgagcgcaacccacatccttagttaccagcggttcggccggggactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgtccccatgaagtcggaatcgctagtaatcgcgtaacagcatgacgcggtgaatacgttcccgggccttgtacacaccgcccgtcacaccatgggagttgggtctacccgacggccgtgcgctaactcttcggaggggcagcggaccacggtaggctcagcgactggggtgaagtcgtaacaaggtagccgtaggggaacctgcggctggatcacctcctttctaa

SEQ ID NO: 2567 - DNA, 1473 bp, Celeribacter halophilus
  ref <308>: DATABASE ACCESSION NUMBER: NCBI ACCESSION: NZ_FORY01000057.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcacgcctaacacatgcaagtcgaacgagatcttcggatctagtggcggacgggttagtaacgcgtgggaacgtacccttcactacggaatagtcccgggaaactgggtttaataccgtatacgcccttcgggggaaagaatttcggtgagggatcggcccgcgttagattagttagttggtggggtaatggcctaccaagactacgatctatagctggtttgagaggatgatcagcaacactgggactgagacacggcccagactcctacgggaggcagcagtggggaatcttagacaatgggggcaaccctgatctagcgatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtaagtggaattccgagtgtagaggtgaaattcgtagatattcggaggaacaccagtggcgaaggcggcttactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggattagagagatcttttccttcagttcggctggatcagtgacaggtgctgcatggctgtcgtcagctcgtgtcgtgagatgttcggttaagtccggcaacgagcgcaacccacatccttagttaccagcggttcggccggggactctagggaaactgcccgtgataagcgggaggaaggtgtggatgacgtcaagtcctcatggcccttacgggttgggctacacacgtgctacaatggcaactacagtgggttaatccccaaaagttgtctcagttcggattggggtctgcaactcggccccatgaagtcggaatcgctagtaatcgcgtaacagcatgacgcggtgaatacgttcccgggccttgtacacaccgcccgtcacaccatgggagttgggtctacccgacggccgtgcgccaacctcttcggagggggcagcggaccacggtaggctcagcgactggggtgaagtcgtaacaaggtagccgtaggggaacctgcggctggatcacctcctttctaa

SEQ ID NO: 2568 - DNA, 1469 bp, Celeribacter indicus
  ref <308>: DATABASE ACCESSION NUMBER: NCBI ACCESSION: NZ_FNNW01000057.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgaacgaagccttcgggcttagtggcggacgggttagtaacgcgtgggaacgtgcccttcactacggaatagtcccgggaaactgggtttaataccgtatacgcccttcgggggaaagaatttcggtgagggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggggcaaccctgatctagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcgcgcatgcgtgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctggtcgcggttacgagagatcgtttccttcagttcggctggaccagtgacaggtgctgcatggctgtcgtcagctcgtgtcgtgagatgttcggttaagtccggcaacgagcgcaacccacacccttagttaccagcggttcggccggggactctaggggaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgtccccatgaagtcggaatcgctagtaatcgcgtaacagcatgacgcggtgaatacgttcccgggccttgtacacaccgcccgtcacaccatgggagttgggtctacccgacggccgtgcgctaaccttttggaggcagcggaccacggtaggctcagcgactggggtgaagtcgtaacaaggtagccgtaggggaacctgcggctggatcacctcctttctaa

SEQ ID NO: 2569 - DNA, 1474 bp, Celeribacter manganoxidans
  ref <308>: DATABASE ACCESSION NUMBER: NCBI ACCESSION: NZ_CP021404.1
  ref <309>: DATABASE ENTRY DATE: 2019-04-01
  ref <313>: RELEVANT RESIDUES IN SEQ ID NO: (1)..(1474)
caacttgagagtttgatcctggctcagaacgaacgctggcggcaggcctaacacatgcaagtcgagcgagatcttcggatctagcggcggacgggttagtaacgcgtgggaacgtgcccttcactacggaatagtcccgggaaactgggtttaataccgtatacgcccttcgggggaaagatttatcggtgaaggatcggcccgcgtctgattagatagttggtggggtaatggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggactaataagtcagaggtgaaatcccagggctcaaccttggaactgcctttgatactgttagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaaactcaaaggaattgacgggggcccgcacaagcggtggagcatgtggtttaattcgaagcaacgcgcagaaccttaccaacccttgacatcctgatcgcggttacgagagatcgtttccttcatttagttggatcagtgacaggtgctgcatggctgtcgtcagctcgtgtcgtgagatgttcggttaagtccggcaacgagcgcaacccacacctttagttgccagcagttcggctgggcactctaaaggaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaaggtggtgcgccaacctgttcgcaggaggcagccaaccacggtaggatcagcgactggggtgaagtcgtaacaaggtagccgtaggggaacctgcggctggatcacctcctttctaa

SEQ ID NO: 2570 - DNA, 1471 bp, Celeribacter marinus
  ref <308>: DATABASE ACCESSION NUMBER: NCBI ACCESSION: NZ_FOSM01000017.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcacgcctaacacatgcaagtcgagcgctaccttcgggtggagcggcggacgggttagtaacgcgtgggaacgtacccagatctgcggaatagcctttggaaacgaagagtaataccgcatacgcccttcgggggaaagatttatcggatttggatcggcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagcgatgccgcgtgagtgatgaaggccttagggtcgtaaagctctttcgcctgtgatgataatgacagtagcaggtaaagaaaccccggctaactccgtgccagcagccgcggtaatacggagggggttagcgttgttcggaattactgggcgtaaagcgcacgtaggcggattaataagtcagaggtgaaatcccagggctcaaccctggaactgcctttgatactgttagtcttgagttcgagagaggtaagtggaattccgagtgtagaggtgaaattcgtagatattcggaggaacaccagtggcgaaggcgacttactggctcgatactgacgctgaggtgcgaaagtgtggggagcaaacaggattagataccctggtagtccacaccgtaaacgatgaatgccagacgtcgggtagcatgctattcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgcggatcgtagagatactttccttcagttcggctggatatcacacaggtgctgcatggctgtcgtcagctcgtgtcgtgagatgttcggttaagtccggcaacgagcgcaacccacatccttagttaccagcggttcggccggggactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgacggccgtgcgctaactcttcggagaggcagcggaccacggtaggctcagcgactggggtgaagtcgtaacaaggtagccgtaggggaacctgcggctggatcacctcctttcta

SEQ ID NO: 2571 - DNA, 1470 bp, Celeribacter neptunius
  ref <308>: DATABASE ACCESSION NUMBER: NCBI ACCESSION: NZ_FORH01000018.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcctaacacatgcaagtcgagcgcgaccttcgggttgagcggcggacgggttagtaacgcgtgggaacgtacccagatctacggaatagcctcgggaaactgagagtaataccgtatacgccctttgggggaaagatttatcggatttggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggggcaaccctgatctagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcacgtaggcggattagtcagtcagaggtgaaatcccagggctcaaccctggaactgcctttgatactgctagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagtatacttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttacgagagatcgtttccttcagttcggctggatcagtgacaggtgctgcatggctgtcgtcagctcgtgtcgtgagatgttcggttaagtccggcaacgagcgcaacccacatccttagttaccagcggtttggccggggactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcggccccatgaagtcggaatcgctagtaatcgcgtaacagcatgacgcggtgaatacgttcccgggccttgtacacaccgcccgtcacaccatgggagttgggtctacccgacggccgtgcgccaaccttttggaggcagcggaccacggtaggctcagcgactggggtgaagtcgtaacaaggtagccgtaggggaacctgcggctggatcacctcctttctaa

SEQ ID NO: 2572 - DNA, 1469 bp, Celeribacter persicus
  ref <308>: DATABASE ACCESSION NUMBER: NCBI ACCESSION: NZ_QAOH01000052.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgaacgaagccttcgggcttagtggcggacgggttagtaacgcgtgggaacgtgcccttcactacggaatagtcccgggaaactgggtttaataccgtatacgcccttcgggggaaagaatttcggtgagggatcggcccgcgttagattaggtagttggtggggtaatggcctaccaagcctacgatctatagctggtttgagaggatgatcagcaacactgggactgagacacggcccagactcctacgggaggcagcagtggggaatcttagacaatgggggcaaccctgatctagccatgccgcgtgagtgatgaaggccttagggtcgtaaagctctttcgcctgtgaagataatgacggtagcaggtaaagaaaccccggctaactccgtgccagcagccgcggtaatacggagggggttagcgttgttcggaattactgggcgtaaagcgcgcgtaggcggatatttaagtcagaggtgaaatcccggggctcaaccccggaactgcctttgatactggatgtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagtatacttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacatccttagttaccagcggttcggccggggactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgtccccatgaagtcggaatcgctagtaatcgcgtaacagcatgacgcggtgaatacgttcccgggccttgtacacaccgcccgtcacaccatgggagttgggtctacccgacggccgtgcgctaaccttttgggggcagcggaccacggtaggctcagcgactggggtgaagtcgtaacaaggtagccgtaggggaacctgcggctggatcacctcctttctaa

SEQ ID NO: 2573 - DNA, 1529 bp, Cellulomonas fimi
  ref <308>: DATABASE ACCESSION NUMBER: NCBI ACCESSION: NZ_LR134387.1
  ref <309>: DATABASE ENTRY DATE: 2019-04-01
  ref <313>: RELEVANT RESIDUES IN SEQ ID NO: (1)..(1529)
tttacggagagtttgattctggctcaggacgaacgctggcggcgtgcttaacacatgcaagtcgaacggtgatgacagggcttgctctgtctgatcagtggcgaacgggtgagtaacacgtgagcaacctgcccctgactctgggataacgaccggaaacggtcgctaataccggatatgagacgtacaggcatctgttgcgtctggaaagtttttcggtcagggatgggctcgcggcctatcagcttgttggtggggtaacggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaacctcaggctcaacctggggcttgcagtgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggctcattccacgagctctgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaaagtgcagagatgtgctccccgtaaggtcggtgtacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtcgtaacaaggtagccgtaccggaaggtgcggctggatcacctcctttctaagga

SEQ ID NO: 2574 - DNA, 1533 bp, Cellulomonas sp. HLT2-17
  ref <308>: DATABASE ACCESSION NUMBER: NCBI ACCESSION: NZ_SDWW01000085.1
  ref <309>: DATABASE ENTRY DATE: 2019-04-01
  ref <313>: RELEVANT RESIDUES IN SEQ ID NO: (1)..(1533)
tttacggagagtttgattctggctcaggacgaacgctggcggcgtgcttaacacatgcaagtcgaacggtgatatcagggcttgctctggttgatcagtggcgaacgggtgagtaacacgtgagtaacctgcccctgactctgggataacttcgggaaatcggagctaataccggatatgagacgtcctcgcatggggagcgtctggaaagatttatcggtctgggatggactcgcggcctatcagcttgttggtgaggtaatggctcaccaaggcgacgacgggtagccggcctgagagggcgaccggccacactgggactgagatacggcccagactcctacgggaggcagcagtggggaatattgcacaatgggcgaaagcctgatgcagcgacgccgcgtgagggatgaaggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaactcgaggctcaacctcgggcttgcagtgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagctaacgcattaagtgccccgcctggggagtacggccgcaaggctaaaactcaaagaaattgacgggggcccgcacaagcggcggagcatgcggattaattcgatgcaacgcgaagaaccttaccaaggcttgacatataccggaaaagtgcagagatgtgctccccgcaaggtcggtatacaggtggtgcatggttgtcgtcagctcgtgtcgtgagatgttgggttaagtcccgcaacgagcgcaaccctcgtcctatgttgccagcgggtcatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaaccttttcggaggagggagctgtcgaaggtgggactggcgattgggactaagtcgtaacaaggtagccgtaccggaaggtgcggctggatcacctcctttctaagga

SEQ ID NO: 2575 - DNA, 1528 bp, Cellulomonas sp. NEAU-TCZ24
  ref <308>: DATABASE ACCESSION NUMBER: NCBI ACCESSION: NZ_QWKP01000081.1
  ref <309>: DATABASE ENTRY DATE: 2019-04-01
  ref <313>: RELEVANT RESIDUES IN SEQ ID NO: (1)..(1528)
ttaacggagagtttgattctggctcaggacgaacgctggcggcgtgcttaacacatgcaagtcgaacggtgatggccagcttgctggtctgatcagtggcgaacgggtgagtaacacgtgagcaacctgcccttcactctgggataaccacgggaaacggtggctaataccggatacgagacgtacctgcatgggtggcgtctggaaagatttatcggtggaggatgggctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaacctgaggctcaacctcgggcttgcagtgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcttatgttgccagcgggttatgccggggactcataagagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagctgtcgaaggtgggactggcgattgggactaagtcgtaacaaggtagccgtaccggaaggtgcggctggatcacctcctttctaagga

SEQ ID NO: 2576 - DNA, 1529 bp, Cellulomonas sp. NEAU-YY56
  ref <308>: DATABASE ACCESSION NUMBER: NCBI ACCESSION: NZ_RFFI01000175.1
  ref <309>: DATABASE ENTRY DATE: 2019-04-01
  ref <313>: RELEVANT RESIDUES IN SEQ ID NO: (1)..(1529)
tctacggagagtttgattctggctcaggacgaacgctggcggcgtgcttaacacatgcaagtcgaacggtgaagcccagcttgctgggtggatcagtggcgaacgggtgagtaacacgtgagtaacctgcccctgactctgggataagccttggaaacgaggtctaataccggatacgagacgctcgtgcatgcgaagtgtctggaaagatttatcggtcagggatggactcgcggcctatcagcttgttggtggggtaacggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgaaggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaactcgaggctcaacctcgggcttgcagtgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcacgtgatggtggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaactgttcgcagggggagccgtcgaaggtgggactggcgattgggactaagtcgtaacaaggtagccgtaccggaaggtgcggctggatcacctcctttctaagga

SEQ ID NO: 2577 - DNA, 1327 bp, Cellulomonas sp. PhB143
  ref <308>: DATABASE ACCESSION NUMBER: NCBI ACCESSION: NZ_RKIJ01000006.1
  ref <309>: DATABASE ENTRY DATE: 2019-04-01
  ref <313>: RELEVANT RESIDUES IN SEQ ID NO: (1)..(1327)
gtggaaagatttatcggttggggatggtctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgaaggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaacctcaggctcaacctggggcgtgcatcgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaaggaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcacgtgatggtggggactcataggagactgccggggtcaactcggaggaaggtggggatgacgtcaaatcatcatgccccttatgtcttgggcttcacgcatgctacaatggccggtacaaagggctgcgataccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggaccggcgattgggactaagtcgtaacaaggtagccgtaccggaaggtgcggctggatcacctcctttctaagga

SEQ ID NO: 2578 - DNA, 1528 bp, Cellulomonas sp. PhB150
  ref <308>: DATABASE ACCESSION NUMBER: NCBI ACCESSION: NZ_RKHX01000007.1
  ref <309>: DATABASE ENTRY DATE: 2019-04-01
  ref <313>: RELEVANT RESIDUES IN SEQ ID NO: (1)..(1528)
ttaacggagagtttgattctggctcaggacgaacgctggcggcgtgcttaacacatgcaagtcgaacggtgacgaccagcttgctggtctgatcagtggcgaacgggtgagtaacacgtgagcaacctgcccttcactctgggataaccacgggaaacggtggctaataccggatacgagacgtacctgcatgggtggcgtctggaaagatttatcggtgaaggatgggctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaacctgaggctcaacctcgggcttgcagtgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaacttccagagatggttgccccgcaaggtcggtgtacaggtggtgcatggttgtcgtcagctcgtgtcgtgagatgttgggttaagtcccgcaacgagcgcaaccctcgtcctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggagggagctgtcgaaggtgggactggcgattgggactaagtcgtaacaaggtagccgtaccggaaggtgcggctggatcacctcctttctaagga

SEQ ID NO: 2579 - DNA, 1530 bp, Cellulomonas sp. SYSUP0004
  ref <308>: DATABASE ACCESSION NUMBER: NCBI ACCESSION: NZ_RWJX01000158.1
  ref <309>: DATABASE ENTRY DATE: 2019-04-01
  ref <313>: RELEVANT RESIDUES IN SEQ ID NO: (1)..(1530)
ttgacggagagtttgattctggctcaggacgaacgctggcggcgtgcttaacacatgcaagtcgaacggtgatccccagcttgctggggtgatcagtggcgaacgggtgagtaacacgtgagtaacctgcccctgactctgggataactgctggaaacggtggctaataccggatatgacaccgctgcgcatgtggtggtgtggaaagtttttcggtcagggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggtgtgtcgcgtctgctgtgaaaaccttaggctcaacctggggcttgcagtgggtacgggcacactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggtccattccacgggttccgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatgcaccggaaaccctcagagatgggggccccgcaaggctggtgcacaggtggtgcatggttgtcgtcagctcgtgtcgtgagatgttgggttaagtcccgcaacgagcgcaaccctcgtcccatgttgccagcgggtagtgccggggactcatgggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacacgcttgcgtgagggagctgtcgaaggtgggactggcgattgggactaagtcgtaacaaggtagccgtaccggaaggtgcggctggatcacctcctttctaaggag

SEQ ID NO: 2580 - DNA, 1527 bp, Cellulomonas sp. TKZ-21
  ref <308>: DATABASE ACCESSION NUMBER: NCBI ACCESSION: NZ_BHYL01000127.1
  ref <309>: DATABASE ENTRY DATE: 2019-04-01
  ref <313>: RELEVANT RESIDUES IN SEQ ID NO: (1)..(1527)
tttacggagagtttgattctggctcaggacgaacgctggtggcgtgcttaacacatgcaagtcgaacggtgacgaccagcttgctggtctgatcagtggcgaacgggtgagtaacacgtgagcaacctgcccctgactctgggataacgaccggaaacggtcgctaataccggatatgagaggcccgggcatccgggtttctggaaagtttttcggtcagggatgggctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccacgtgagggatgacggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctgctgtgaaaacctcaggctcaacctggggcttgcagtgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacaggattagataccctggtagtccatgccgtaaacgttgggcactaggtgtggggctcattccacgagctctgtgccgcagcaaacgcattaagtgccccgcctggggagtacggccgcaaggctaaaactcaaagaaattgacgggggcccgcacaagcggcggagcatgcggattaattcgatgcaacgcgaagaaccttaccaaggcttgacatacaccggaaaagtgcagagatgtgctccccgtaaggtcggtgtacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacaaagggctgcgataccgcgaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccagtggcccaactcgtaagagagggagctgtcgaaggtgggactggcgattgggactaagtcgtaacaaggtagccgtaccggaaggtgcggctggatcacctcctttctaagga

SEQ ID NO: 2581 - DNA, 1542 bp, Cellulosilyticum lentocellum
  ref <308>: DATABASE ACCESSION NUMBER: NCBI ACCESSION: NC_015275.1
  ref <309>: DATABASE ENTRY DATE: 2019-04-01
  ref <313>: RELEVANT RESIDUES IN SEQ ID NO: (1)..(1542)
ttttatatgagagtttgatcctggctcaggatgaacgctggcggcgtgcttaacacatgcaagtcgaacgaagtgataggagcttgctcctagaacttagtggcggacgggtgagtaacgcgtgggtaacctgccctatgcagggggataacgtttggaaacgaacgctaataccgcataaactatggacaatcgcatgattgttatagtaaagattttatcggcataggatggacccgcgttggattagctagttggtgagataacagcccaccaaggcgacgatccatagccggcctgagagggtgaacggccacattgggactgagacacggcccaaactcctacgggaggcagcagtggggaatattgcacaatgggcgcaagcctgatgcagcgacgccgcgtgaaggaagaaggtcttcggattgtaaacttctatcagcagggaagaaaaaatgacggtacctgactaagaagctccggctaactacgtgccagcagccgcggtaatacgtagggagcgagcgttatccggatttactgggtgtaaagggtgcgtaggcggtttgttaagtcagaagtgaaatttaggggctcaacctctaagctgcttctgaaactgatgaactagagtgtgggagaggaaagtggaattccgagtgtagcggtgaaatgcgtagagattcggaggaacaccagtagcgaaggcggctttctggaccataactgacgctgaggcacgaaagcgtggggagcaaacaggattagataccctggtagtccacgctgtaaacgatgaatgctaggtgtcggggcttacgggtctcggtgccgaaagttaacacaattaagcattcccacctgggaagtacgatcgcaagattagaaactacaaaaggaattgacggggacccgcacaagcggtggagcatgtcggtttaattcgaagcaacgcgaagaaccttacctaaacttgacatccttttgactagagggtaatgcctctttctctagcttgctagagcagaagtgacaggtggtgcatggttgtcgtcagctcgtgtcgtgagatgttgggttaagtcccgcaacgagcgcaacccctatctttagtagccagcattaagttgggcactctagagagactgccagggataacttggaggaaggtggggatgacgtcaaatcatcatgccccttatgtttagggctacacacgtgctacaatggctgctacaaagggaagcgatctcgcgagagtcagcaaacctcaaaaaagcagtcccagttcggattgtagtctgcaactcgactacatgaagttggaatcgctagtaatcgcgaatcagaatgtcgcggtgaatacgttcccgggtcttgtacacaccgcccgtcacaccatgggagttgggggggcccaacgccggtgacccaacccttcggggagggagccgtctaaggcaaaaccaataactggggtgaagtcgtaacaaggtagccgtatcggaaggtgcggctggatcacctcctttctaagga

SEQ ID NO: 2582 - DNA, 1536 bp, Cellulosilyticum ruminicola
  ref <308>: DATABASE ACCESSION NUMBER: NCBI ACCESSION: NZ_BBCG01000153.1
  ref <309>: DATABASE ENTRY DATE: 2019-04-01
  ref <313>: RELEVANT RESIDUES IN SEQ ID NO: (1)..(1536)
ttttttatgagagtttgatcctggctcaggatgaacgctggcggcgtgcttaacacatgcaagtcgaacgaactgaggagagcttgctctccaaagttagtggcggacgggtgagtaacgcgtgggtaacctgcctcatgcagggggataacgtttggaaacgaacgctaataccgcataaactatggattaccgcatggtaattatagcaaagatttatcggcatgagatggacccgcgttggattagctagttggtgagataacagcccaccaaggcgacgatccatagccggcctgagagggtgaacggccacattgggactgagacacggcccaaactcctacgggaggcagcagtggggaatattgcacaatgggcgcaagcctgatgcagcgacgccgcgtgaaggaagaaggtcttcggattgtaaacttctatcagcagggaagaaaaaaatgacggtacctgactaagaagctccggctaactacgtgccagcagccgcggtaatacgtagggagcgagcgttatccggatttactgggtgtaaagggtgcgtaggcggcatggtaagtcagaagtgaaattttggggctcaactccagagctgcttctgaaactgctgtgctagagtgtgggagaggaaagtggaattccgagtgtagcggtgaaatgcgtagagattcggaggaacaccagtagcgaaggcggctttctggaccataactgacgctgaggcacgaaagcgtggggagcaaacaggattagataccctggtagtccacgccgtaaacgatgaatgctaggtgtcggcccttacgggggtcggtgccgaagttaacacattaagcattccacctgggaagtacgatcgcaagattgaaactcaaaggaattgacggggacccgcacaagcggtggagcatgtggtttaattcgaagcaacgcgaagaaccttacctaaacttgacatccttctgaccggtctttaatcggacttttcagtgcttgcactgacggaagtgacaggtggtgcatggttgtcgtcagctcgtgtcgtgagatgttgggttaagtcccgcaacgagcgcaacccctatccttagtagccatcattaagttgggcactctagggagactgccagggataacttggaggaaggtggggatgacgtcaaatcatcatgccccttatgtttagggctacacacgtgctacaatggctgctacaaagggaagcaatgccgcgaggccgagcgaacctcaaaaaagcagtcccagttcggattgtagtctgcaactcgactacatgaagttggaatcgctagtaatcgcgaatcagaatgtcgcggtgaatacgttcccgggtcttgtacacaccgcccgtcacaccatgggagttgagggggcccaacgtcggtgacccaacccgtaagggagggagccgcctaaggcaaaatcaataactggggtgaagtcgtaacaaggtagccgtatcggaaggtgcggctggatcacctcctttctaaggaa

SEQ ID NO: 2583 - DNA, 1249 bp, Cellulosilyticum sp. I15G10I2
  ref <308>: DATABASE ACCESSION NUMBER: NCBI ACCESSION: NZ_FMMP01000013.1
  ref <309>: DATABASE ENTRY DATE: 2019-04-01
  ref <313>: RELEVANT RESIDUES IN SEQ ID NO: (1)..(1249)
acgatccatagccggcctgagagggtgaacggccacactgggactgagacacggcccagactcctacgggaggcagcagtggggaatattgcacaatgggcgcaagcctgatgcagcgacgccgcgtgaaggatgaaggtcttcggattgtaaacttctatcagcagggaagaataaatgacggtacctgactaagaagccccggctaactacgtgccagcagccgcggtaatacgtagggggcgagcgttatccggaattactgggtgtaaagggtgcgtaggcggctatgcaagtcagatgtgaaaactcagggctcaaccttgaggctgcatctgaaactgtgtagctagagtgtgggagaggaaagtggaattccgagtgtagcggtgaaatgcgtagagattcggaggaacaccagtagcgaaggcggctttctggaccataactgacgctgaggcacgaaagcgtggggagcaaacaggattagataccctggtagtccacgctgtaaacgatgaatgctaggtgttgggggcgacagctttcagtgccgaagttaacacattaagcattccacctgggaagtacgatcgcaagattgaaactcaaaggaattgacggggacccgcacaagcggtggagcatgtggtttaattcgaagcaacgcgaagaaccttacctaaacttgacatccttttgaccggatcttaatcgatcctttcagggcttgccctgacagaagtgacaggtggtgcatggttgtcgtcagctcgtgtcgtgagatgttgggttaagtcccgcaacgagcgcaacccttatctttagtagccatcattaagttgggcactctagagagactgccagggataacctggaggaaggtggggatgacgtcaaatcatcatgccccttatgtttagggctacacacgtgctacaatggctgctacaaagggaagcgatctagtgatagtcagcaaacctcaaaaaagcagtcccagttcggattgtagtctgcaactcgactacatgaagttggaatcgctagtaatcgcgaatcagaatgtcgcggtgaatacgttcccgggtcttgtacacaccgcccgtcacaccatggaagttgggggggcccaacgtcggtgacctaacccttcggggaaggagccgcctaaggcaaaaccaatgactggggtgaagtcgtaacaaggtagccgtatcggaaggtgcggctggatcacctcctttct

SEQ ID NO: 2584 - DNA, 1536 bp, Cellulosilyticum sp. WCF-2
  ref <308>: DATABASE ACCESSION NUMBER: NCBI ACCESSION: NZ_CP034675.1
  ref <309>: DATABASE ENTRY DATE: 2019-04-01
  ref <313>: RELEVANT RESIDUES IN SEQ ID NO: (1)..(1536)
tttatatgagagtttgatcctggctcaggatgaacgctggcggcgtgcttaacacatgcaagtcgaacgaagtgataggagcttgctcctagaacttagtggcggacgggtgagtaacgcgtgggtaacctgccctatgcagggggataacgtttggaaacgaacgctaataccgcataaactatggacgatcgcatgattgttatagtaaagattttatcggcataggatggacccgcgttggattagctagttggtgagataacagcccaccaaggcgacgatccatagccggcctgagagggtgaacggccacattgggactgagacacggcccaaactcctacgggaggcagcagtggggaatattgcacaatgggcgcaagcctgatgcagcgacgccgcgtgaaggaagaaggtcttcggattgtaaacttctatcagcagggaagaaaaaaatgacggtacctgactaagaagctccggctaactacgtgccagcagccgcggtaatacgtagggagcgagcgttatccggatttactgggtgtaaagggtgcgtaggcggtttgttaagtcagaagtgaaatttaggggctcaacctctaagctgcttctgaaactgatgaactagagtgtgggagaggaaagtggaattccgagtgtagcggtgaaatgcgtagagattcggaggaacaccagtagcgaaggcggctttctggaccataactgacgctgaggcacgaaagcgtggggagcaaacaggattagataccctggtagtccacgctgtaaacgatgaatgctaggtgtcggggcttacgggtctcggtgccgaagttaacacattaagcattccacctgggaagtacgatcgcaagattgaaactcaaaggaattgacggggacccgcacaagcggtggagcatgtggtttaattcgaagcaacgcgaagaaccttacctaaacttgacatccttttgactagagggtaatgcctctttctctagcttgctagagcagaagtgacaggtggtgcatggttgtcgtcagctcgtgtcgtgagatgttgggttaagtcccgcaacgagcgcaacccctatctttagtagccagcattgagttgggcactctagagagactgccagggataacttggaggaaggtggggatgacgtcaaatcatcatgccccttatgtttagggctacacacgtgctacaatggctgctacaaagggaagcgatctcgcgagagtcagcaaacctcaaaaaagcagtcccagttcggattgtagtctgcaactcgactacatgaagttggaatcgctagtaatcgcgaatcagaatgtcgcggtgaatacgttcccgggtcttgtacacaccgcccgtcacaccatgggagttgggggggcccaacgccggtgacccaacccttcggggagggagccgtctaaggcaaaaccaataactggggtgaagtcgtaacaaggtagccgtatcggaaggtgcggctggatcacctcctttctaaggaa

SEQ ID NO: 2585 - DNA, 1526 bp, Cellulosimicrobium sp. MM
  ref <308>: DATABASE ACCESSION NUMBER: NCBI ACCESSION: NZ_JPQW01000072.1
  ref <309>: DATABASE ENTRY DATE: 2019-04-01
  ref <313>: RELEVANT RESIDUES IN SEQ ID NO: (1)..(1526)
tttacggagagtttgatcctggctcaggacgaacgctggcggcgtgcttaacacatgcaagtcgaacgatgaatgcccagcttgctgggcggattagtggcgaacgggtgagtaacacgtgagtaacctgcccttgacttcgggataactccgggaaaccggggctaataccggatatgagccgtcctcgcatgggggtggttggaaagtttttcggtcagggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacgagaagccaccagagatggtggtctctttggacactcgtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagcccatggcccaaccgttcgcggggggagtggtcgaaggtgggactggcgattgggactaagtcgtaacaaggtagccgtaccggaaggtgcggctggatcacctcctttcta

SEQ ID NO: 2586 - DNA, 1529 bp, Cellulosimicrobium terreum
  ref <308>: DATABASE ACCESSION NUMBER: NCBI ACCESSION: NZ_SDBQ01000002.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacgatgatgcccagcttgctgggtggattagtggcgaacgggtgagtaacacgtgagtaacctgcccttgacttcgggataactccgggaaaccggggctaataccggatatgagccgccttcgcatgggggtggttggaaagtttttcggtcagggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgaaggccttcgggttgtaaacctctttcagcagggaagaagcgcaagtgacggtacctgcagaagaagcgccggctaactacgtgccagcagccgcggtaatacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacaggattagataccctggtagtccatgccgtaaacgttgggcactaggtgtggggctcattccacgagttccgtgccgcagcaaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcacgggaagccaccagagatggtggtctctttggacactcgtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagcccatggcccaaccgttcgcggggggagtggtcgaaggtgggactggcgattgggactaagtcgtaacaaggtagccgtaccggaaggtgcggctggatcacctcctttctaagga

SEQ ID NO: 2587 - DNA, 1535 bp, Cellvibrionaceae bacterium 1162T.S.0a.05
  ref <308>: DATABASE ACCESSION NUMBER: NCBI ACCESSION: NZ_LANB01000001.1
  ref <309>: DATABASE ENTRY DATE: 2019-04-01
  ref <313>: RELEVANT RESIDUES IN SEQ ID NO: (1)..(1535)
taaactgaagagtttgatcatggctcagattgaacgctggcggcaggcctaacacatgcaagtcgagcgtgaaagccttcgggtgagtaaagcggcggacgggtgagtaacgcgtgggaatctgcccggtagtgggggacaacagtcggaaacgactgctaataccgcatacgccctaagggggaaagcaggggatcttcggaccttgcgctatcggatgagcccgcgtgagattagcttgttggtggggtaaaggcctaccaaggcgacgatctctagctggtctgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttaatcagtgaggaaaggttgaaggttaataccctatcagctgtgacgttaactgaagaataagcaccggctaactccgtgccagcagccgcggtaatacggagggtgcaagcgttaatcggaattactgggcgtaaagcgcgcgtaggcggtgatccaagctggatgtgaaatccccgggctcaacctgggaactgcattcagaactggattgctagagtacagaagaggggtgtggaatttccggtgtagcggtgaaatgcgtagagatcggaaggaacatcagtggcgaaggcgacaccctggtctgatactgacgctgaggtgcgaaagcgtgggtagcaaacaggattagataccctggtagtccacgccgtaaacgatgtctactagccgttggtatccttgaggtatcagtggcgcagctaacgcagtaagtagaccgcctggggagtacggccgcaaggttaaaactcaaatgaattgacgggggcccgcacaagcggtggagcatgtggtttaattcgaagcaacgcgaagaaccttaccaggtcttgacatccagagaacctttcagagatgagagggtgccttcgggaattctgagacaggtgctgcatggctgtcgtcagctcgtgtcgtgagatgttgggttaagtcccgtaacgagcgcaacccttgtccttggttgccagcacataatggtgggaactctaaggagactgccggtgacaaaccggaggaaggtggggacgacgtcaagtcatcatggcccttacgacctgggctacacacgtgctacaatgggaagtacagagggttgccaagcagtgatgtggagctaatcccttaaaacttttcgtagtccggattggagtctgcaactcgactccatgaagtcggaatcgctagtaatcgcaaatcagcatgttgcggtgaatacgttcccgggccttgtacacaccgcccgtcacaccatgggagtgggttgcaaaagaagtggctagtttaaccttcgggagaacggtcaccactttgtgattcatgactggggtgaagtcgtaacaaggtagccctaggggaacctggggctggatcacctccttaa

SEQ ID NO: 2588 - DNA, 1538 bp, Cellvibrionaceae bacterium Bs12
  ref <308>: DATABASE ACCESSION NUMBER: NCBI ACCESSION: NZ_JDFY01000001.1
  ref <309>: DATABASE ENTRY DATE: 2019-04-01
  ref <313>: RELEVANT RESIDUES IN SEQ ID NO: (1)..(1538)
taaactgaagagtttgatcatggctcagattgaacgctggcggcaggcctaacacatgcaagtcgagcgtgaaagccttcgggtgagtagagcggcggacgggtgagtaacgcgtgggaatctacctagtagtgggggacaacagttggaaacggctgctaataccgcatacgccctacgggggaaaggaggggatcttcggacctttcgctattggatgagcccgcgtgagattagatagttggtggggtaaaggcccaccaagtcaacgatctctagctggtctgagaggatgatcagccacactggaactgagacacggtccagactcctacgggaggcagcagtggggaatattgcacaatgggcgaaagcctgatgcagccatgccgcgtgtgtgaagaaggctctagggttgtaaagcactttcagtagggaggaaaggttgtaaattaatactttgcaactgtgacgttacctacagaagaagcaccggctaactccgtgccagcagccgcggtaatacggagggtgcaagcgttaatcggaattactgggcgtaaagcgcgcgtaggtggttatttaagctagatgtgaaagcccagggctcaaccttggaactgcatttagaactgggtaactagagtacagcagaggatagtggaatttcaggtgtagcggtgaaatgcgtagagatctgaaggaacatcagtggcgaaggcgactgtctgggctgatactgacactgaggtgcgaaaagcgtggggagcaaacaggattagataccctggtagtccacgccgtaaacgatgtctactagccgttgggatccttgaggtcttagtggcgcagctaacgcaataagtagaccgcctggggagtacggtcgcaagattaaaactcaaatgaattgacgggggcccgcacaagcggtggagcatgtggtttaattcgaagcaacgcgaagaaccttaccaggtcttgacatcctagaaacttagcagagatgctttggtgccttcgggaatctagaggacaggtgctgcatggctgtcgtcagctcgtgtcgtgagatgttgggttaagtcccgtaacgagcgcaacccttgtccttagttgccatcaggttatgctgggaactctaaggagactgccggtgacaaaccggaggaaggtggggacgacgtcaagtcatcatggcccttacgacctgggctacacacgtgctacaatgggctgtacaaagggtttgccaagccgcgaggtggagctaatcccataaaacagttcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccaacggtgtgattcatgactggggtgaagtcgtaacaaggtagccctaggggaacctggggctggatcacctccttaa

SEQ ID NO: 2589 - DNA, 531 bp, Centipeda periodontii
  ref <308>: DATABASE ACCESSION NUMBER: NCBI ACCESSION: NZ_GL892083.1
  ref <309>: DATABASE ENTRY DATE: 2019-04-01
  ref <313>: RELEVANT RESIDUES IN SEQ ID NO: (1)..(531)
gtaatgacggtacctgtcgaggaagccacggctaactacgtgccagcagccgcggtaatacgtaggtggcgagcgttgtccggaatcattgggcgtaaagggagcgcaggcgggcatgtaagtctttcttaaaagtgcggggctcaaccccgtgatgggaaagaaactacatgtcttgagtacaggagaggaaagcggaattcccagtgtagcggtgaaatgcgtagatattgggaggaacaccagtggcgaaggcggctttctggactgcaactgacgctgaggctcgaaagccaggggagcgaacgggattagataccccggtagtcctggccgtaaacgatggatactaggtgtgggaggtatcgacccctaccgtgccggagttaacgcaataagtatcccgcctggggagtacggtcgcaagactgaaactcaaaggaattgacggggacccgcacaagcggtggagtatgtggtttaattcgaagcaacgcgaagaaccttaccaggccttgacattgactgaag

SEQ ID NO: 2590 - DNA, 1561 bp, Cephaloticoccus capnophilus
  ref <308>: DATABASE ACCESSION NUMBER: NCBI ACCESSION: NZ_LSZP01000029.1
  ref <309>: DATABASE ENTRY DATE: 2019-04-01
  ref <313>: RELEVANT RESIDUES IN SEQ ID NO: (1)..(1561)
ttcggagagtttgatcctggctcagaatgaacgctggcggcgtggttaagacatgcaagtcgaacgggcttttctgaggtagcaatactttagaagagcaagtggcgaacgggtgcgtaacacgtgaacaatctacctttaagtggggaatagctcgtcgaaaggcgaattaataccgcatgtggtcaggtctcgcatgagatttgaactaaagtcagggaccgcaaggcctgacgcttttagaggagttcgcggcctatcagctagttggcgaggtaatggctcaccaaggctaagacgggtagctggtctgagaggatgatcagccacactggaactgagacacggtccagacacctacgggtggcagcagtttcgaatcattcacaatgggcgaaagcctgatggtgcgacgccgcgtgagggatgacggccttcgggttgtaaacctctgtcactagggaagaaaaactaggcgttaatagcgtctagtctgacttaacctagagaggaagcagtggctaactctgtgccagcagccgcggtaatacagagactgcgagcgttattcggattcactgggcgtaaagggtgcgcaggcggtcgtgtgtgttaggtgtgaaagcccgaggctcaacctcggaactgcgcctaaaactacacgactagagtattggagagggtagcggaattcatggtgtagcagtgaaatgcgtagatatcatgaggaacaccagaggcgaaggcggctacctggacaataactgacgctcaggcacgaaagcgtggggagcaaaagggattagatacccctgtagtccacgccctaaacggtgcacactaggtcttggaggattcgaccccttcagggccccagctaacgcgttaagtgtgccgcctgaggactacggccgcaaggctaaaactcaaaggaattgacgggggcccgcacaagcggtggagcatgtggcttaattcgatgcaacgcgaagaaccttacctagccttgacatgcattggaccgctcctgaaagggagcttttcttcggaaccgatgcacaggtgctgcatggctgtcgtcagctcgtgtcgtgagatgttgcgttaagtcgcgcaacgagcgcaacccctgtccttagttgccagcattcagttgggcactctagggagacaaaccctctttgagggtgggaaggtggggatgacgtcaagtcaggatggcccttacggctagggctgcacacgtgctacaatgcccgatacagagggaagcaataccgcgaggtggagcgaatcctaaaaatcgggcccagttcagatcgcagtctgcaactcgactgcgtgaagttggaatcgctagtaatggcgtatcagctacgacgccgtgaatacgttcccgggccttgtacacaccgcccgtcacatcatgaaagccggttttgcccgaagtgtgtttgccaaccagcaatggaggcggcgccctaaggtgaggctggtgattgggatgaagtcgtaacaaggtagccgtaggggaacctgcggctggatcacctcctttcta

SEQ ID NO: 2591 - DNA, 1566 bp, Cephaloticoccus primus
  ref <308>: DATABASE ACCESSION NUMBER: NCBI ACCESSION: NZ_LSZQ01000061.1
  ref <309>: DATABASE ENTRY DATE: 2019-04-01
  ref <313>: RELEVANT RESIDUES IN SEQ ID NO: (1)..(1566)
ttcttttcggagagtttgatcctggctcagaatgaacgctggcggcgtggttaagacatgcaagtcgaacgggcttttttagagtagcaatactttgaaaaagctagtggcgaacgggtgcgtaacacgtgaacaatctacctttaagtggggaatagctcgtcgaaaggcgaattaataccgcatgtggtcaggcttcgcatgaagcctgaactaaagtcagggaccgcaaggcctgacgcttatagaggagttcgcggcctatcagctagttggcgaggtaatggctcaccaaggctaagacgggtagctggtctgagaggatgatcagccacactggaactgagacacggtccagacacctacgggtggcagcagtttcgaatcattcacaatgggcgaaagcctgatggtgcgacgccgcgtgagggatgacggccttcgggttgtaaacctctgtcaccagggaagaaaaaccaggcgttaatagcgtctggtctgacttaacctggagaggaagcagtggctaactctgtgccagcagccgcggtaatacagagactgcgagcgttattcggattcactgggcgtaaagggtgcgcaggcggtcgtgtgtgttaggtgtgaaagcccgaggctcaacctcggaactgcgcctaaaactacacgactagagtattggagagggtagcggaattcatggtgtagcagtgaaatgcgtagatatcatgaggaacaccagaggcgaaggcggctacctggacaataactgacgctcaggcacgaaagcgtggggagcaaaagggattagatacccctgtagtccacgccctaaacggtgcacactaggtcttggaggattcgaccccttcagggcccaagctaacgcgttaagtgtgccgcctgaggactacggccgcaaggctaaaactcaaaggaattgacgggggcccgcacaagcggtggagcatgtggcttaattcgatgcaacgcgaagaaccttacctagccttgacatgcactggaccggccttgaaaggggcctttccttcgggaccggtgcacaggtgctgcatggctgtcgtcagctcgtgtcgtgagatgttgcgttaagtcgcgcaacgagcgcaacccctgtccttagttgccagcattcagttgggcactctagggagacaaaccctctctgagggtgggaaggtggggatgacgtcaagtcaggatggcccttacggctagggctgcacacgtgctacaatgcccgatacagagggaagcaataccgcgaggtggagcgaatccttaaaatcgggcccagttcagattgcagtctgcaactcgactgcatgaagttggaatcgctagtaatggcgtatcagctacgacgccgtgaatacgttcccgggccttgtacacaccgcccgtcacatcatgaaagccggttttgcccgaagtgtgtttgccaaccagcaatggaggcggcgccctaaggtgaggctggtgattgggatgaagtcgtaacaaggtagccgtaggggaacctgcggctggatcacctcctttcta

SEQ ID NO: 2592 - DNA, 1469 bp, Cereibacter changlensis
  ref <308>: DATABASE ACCESSION NUMBER: NCBI ACCESSION: NZ_QKZS01000062.1
  ref <309>: DATABASE ENTRY DATE: 2019-04-01
  ref <313>: RELEVANT RESIDUES IN SEQ ID NO: (1)..(1469)
caacttgagagtttgatcctggctcagaatgaacgctggcggcaggcctaacacatgcaagtcgaacgggaccttcgggtctagtggcggacgggtgagtaacgcgtgggaacatgcccaaaggtacgggatagcctcgggaaactgggtgtaataccgtatgtgcccttcgggggaaagatttatcgcctttggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagtggggaagataatgacggtacccacagaagaagccccggctaactccgtgccagcagccgcggtaatacggagggggctagcgttattcggaattactgggcgtaaagcgcacgtaggcggatcggaaagttgggggtgaaatcccagggctcaaccctggaactgccttcaaaactcccggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggtagcatgctattcggtgacacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatggcagtgaccgttccagagatggtcctttctcgtaagagacactgcacacaggtgctgcatggctgtcgtcagctcgtgtcgtgagatgttcggttaagtccggcaacgagcgcaacccacgtccttagttgccagcattcagttgggcactctagggaaactgccggtgataagccggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggaattggttctacccgaaggcggtgcgccaaccagcaatggaggcagccgaccacggtaggatcagtgactggggtgaagtcgtaacaaggtagccgtaggggaacctgcggctggatcacctcctttctaa

SEQ ID NO: 2593 - DNA, 1508 bp, Cetia pacifica
  ref <308>: DATABASE ACCESSION NUMBER: NCBI ACCESSION: NZ_RJVK01000008.1
  ref <309>: DATABASE ENTRY DATE: 2019-04-01
  ref <313>: RELEVANT RESIDUES IN SEQ ID NO: (1)..(1508)
tttatggagagtttgatcctggctcagagtgaacgctggcggcgtgcttaacacatgcaagtcgaggggcagcaggtcggaacttcggttccgatgctggcgaccggcggacgggtgagtaacacgtagctacttgccccacagagggggataacccggggaaacccgggctaataccccatacacccgagaggggaaagcttttgcgctgtgggatagggctgcggcgtatcaggtagttggtggggtaacggcctaccaagccgatgacgcgtagctggtctgagaggatgatcagccacactggaactgagacacggtccagactcctacgggaggcagcagtggggaatcttgggcaatgggcgaaagcctgacccagcaacgccgcgtggaggaagacgcccttcggggtgtaaactccttttctgagggaagagagtgacggtacctcaggaataagctccggctaactccgtgccagcagccgcggtaatacggggggagcgagcgttactcggaatcactgggcgtaaagggtgcgtaggcggcttagtaagttgggagtgaaatcccacggctcaaccgtggaactgcttccaaaactgctaagctagagtccgggagaggctgcgggaattcctggtgtaggggtgaaatccgtagagatcaggaggaatgccgaaagcgaaggcgcgcagctggaacggtactgacgctgaggcacgaaagcgtggggagcaaacaggattagataccctggtagtccacgccctaaacgatggctactagtggttggggggatagtccctcagtcacgcagctaacgcgataagtagcccgcctggggagtacggccgcaaggctaaaactcaaaggaatagacggggacccgaacaagcggtggagcatgtggtttaattcgaagatacgcgaagaaccttacctgggcttgacatccggggaaccctccagagatggaggggtgcctacttcggtaggagccccgagacaggtgctgcatggctgtcgtcagctcgtgtcgtgagatgttgggttaagtcccgcaacgagcgcaacccctgcccttagttggcagcagttcggctggccactctaaggggactgcccgggcaaccgggaggaaggtggggatgacgtcaagtcatcatggcccttatgtccagggcgacacacgtgctacaatggccaggacagagagaggcaaagccgcgaggtggagcaaatctctaaacctggtcccagttcggattgcagtctgcaactcgactgcatgaaggcggaatcgctagtaatcgcggatcagccatgccgcggtgaatacgttcccgggtcttgtactcaccgcccgtcacaccatgggagtcgggctcacccgaagtcggtatccctaagataggggccgccgacggtgggtccggcgactggggtgaagtcgtaacaaggtagccgtaggagaacctgcggctggatcacctcctttctag

SEQ ID NO: 2594 - DNA, 1240 bp, Cetobacterium ceti
  ref <308>: DATABASE ACCESSION NUMBER: NCBI ACCESSION: NZ_FUWX01000057.1
  ref <309>: DATABASE ENTRY DATE: 2019-04-01
  ref <313>: RELEVANT RESIDUES IN SEQ ID NO: (1)..(1240)
aaaattttgaatgaagagtttgatcctggctcaggatgaacgctgacagaatgcttaacacatgcaagtcgacttgaagcaacttcggttgtggaaagtggcggacgggtgagtaacgcgtaaagaacttgcccttcagtctgggacaaccattggaaacgatggctaataccggatattatggaactctcgcatgggaggatcatgaaagctatatgcgctgaaggagagctttgcgttccattagctagttggtgaggtaacggctcaccaaggcgacgatggatagccggcctgagagggtgatcggccacaaggggactgagacacggcccttactcctacgggaggcagcagtggggaatattggacaatggaccaaaagtctgatccagcaattctgtgtgcacgatgaaggttttcggatcgtaaagtgctttcagttgggaagaagaaagtgacggtaccaacagaagaagcgacggctaaatacgtgccagcagccgcggtaatacgtatgtcgcaagcgttatccggatttattgggcgtaaagcgcgtctaggcgggttcataagtctgatgttaaaatgcggggctcaactccgtattgcgttggaaactgtgaacctagagtatcagagaggtgggcggaactacaagtgtagaggtgaaattcgtagatatttgtaggaatgccgatggagaagtcagctcactggatgaatactgacgctaaagcgcgaaagcgtgggtagcaaacaggattagataccctggtagtccacgccgtaaacgatgatcactaggtgttgggggtcgaacctcagcgcccaagctaacgcgataagtgatccgcctggggagtacgcacgcaagtgtgaaactcaaaggaattgacggggacccgcacaagcggtggagcatgtggtttaattcgacgcaacgcgaggaaccttaccagcgtttgacatcctaagaacttcctagagataggagggtgccggcttgccggaacttagtgacaggtggtgcatggctgtcgtcagctcgtgtcgtgagatgttgggttaagtcccgcaacgagcgcaacccctattgtatgttgctaccattaagttgagcactcatgcgatactgcctgcgacgagcaggaggaaggtggggatgacgtcaagtcatcatgccccttatacgctgggctacacacgtgctacaatgggcaatacaacgagtcgccaa

SEQ ID NO: 2595 - DNA, 1353 bp, Cetobacterium somerae
  ref <308>: DATABASE ACCESSION NUMBER: NCBI ACCESSION: NZ_KI518103.1
  ref <309>: DATABASE ENTRY DATE: 2019-04-01
  ref <313>: RELEVANT RESIDUES IN SEQ ID NO: (1)..(1353)
gatattatgagattctcgcatgggaaacttatgaaagctatatgcgccaagagagagccttgcgttccattagctagttggtggggtaacggcccaccaaggcgacgatggatagccggcctgagagggtgaacggccacaaggggactgagacacggcccttactcctacgggaggcagcagtggggaatattggacaatgggccacaagcctgatccagcaattctgtgtgcacgatgaaggtcttcggattgtaaagtgctttcagttgggaagaagaaagtgacggtaccaacagaagaagcgacggctaaatacgtgccagcagccgcggtaatacgtatgtcgcaagcgttatccggatttattgggcgtaaagcgcgtctaggcggaaaaataagtctgatgttaaaatgcggggctcaactccgtattgcgttggaaactgtttttctagagtactggagaggtgggcggaactacaagtgtagaggtgaaattcgtagatatttgtaggaatgccgatggagaagtcagctcactggacagatactgacgctaaagcgcgaaagcgtggggagcaaacaggattagataccctggtagtccacgccgtaaacgatgatcactaggtgttgggggtcgaacctcagcgcccaagctaacgcgataagtgatccgcctggggagtacgcacgcaagtgtgaaactcaaaggaattgacggggacccgcacaagcggtggagcatgtggtttaattcgacgcaacgcgagaaaccttaccagcgtttgacatcctaagaagtttccagagatggattcgtgccggcttgccggaacttagtgacaggtggtgcatggctgtcgtcagctcgtgtcgtgagatgttgggttaagtcccgcaacgagcgcaacccctattgtatgttgctaccattaagttgagcactcatgcgatactgcctgcgatgagcaggaggaaggtggggatgacgtcaagtcatcatgccccttatacgctgggctacacacgtgctacaatgggcagtacagagagttgccaacccgcgagggtgagctaatctcttaaagctgttcttagttcggattgtactctgcaactcgagtacatgaagttggaatcgctagtaatcgcaaatcagcatgttgcggtgaatacgttctcgggtcttgtacacaccgcccgtcacaccacgagagttggttgcacctgaagtagcaggcctaaccgtaaggagggatgttcctaaggtgtgattagcgattggggtgaagtcgtaacaaggtatccgtacgggaacgtgcggatggatcacctcctttctaagga

SEQ ID NO: 2596 - DNA, 1523 bp, Cetobacterium sp. ZOR0034
  ref <308>: DATABASE ACCESSION NUMBER: NCBI ACCESSION: NZ_JTLI01000095.1
  ref <309>: DATABASE ENTRY DATE: 2019-04-01
  ref <313>: RELEVANT RESIDUES IN SEQ ID NO: (1)..(1523)
cctaatacatgcaagtcgagcgaacggaagaagcgtcttcggacgaattggaagtgagcggcgaacgggtgagtaacacgtaggtaacctgcccttgagatagggataacagttggaaacgactgctaataccgaataggaacagatgaggcatctcatcggtttaaaaggagctttcgggcttcgcttgaggatggacctgcggcgcattagctagttggtggggtaacggcctaccaaggcgacgatgcgtagccgacctgagagggtgatcggccacactgggactgagacacggcccagactcctacgggaggcagcagtagggaattttccacaatggacgcaagtctgatggagcaacgccgcgtgtgcgaagaaggccttcgggttgtaaagcactgttgtaagggaagaatggataggagaggaaatgctcttattatgacggtaccttaccagaaagccacggctaactacgtgccagcagccgcggtaatacgtaggtggcgagcgttatccggaattattgggcgtaaagggcgtgtaggcggtgctttaagtctgacgtgaaagccaacggctcaaccgttgaaatgcgttggaaactggagcacttgagtgtcggagaggaaagcggaattcctagtgtagcggtgaaatgcgtagatattaggaggaacaccagtggcgaaggcggctttctggacgacaactgacgctgaggcgcgaaagcgtggggagcaaacaggattagataccctggtagtccacgccgtaaacgatgagtgctaagtgttgggggagcgatccctcagtgctgaaccaaacggagtaagcactccgcctggggagtacggtcgcaaggctgaaactcaaaggaattgacggggacccgcacaagcggaggagtatgtggtttaattcgaagcaacgcgaagaaccttaccaactcttgacatcccagtgaccgtcctagagataggactttcccttcggggacaatggtgacaggtggtgcatggttgtcgtcagctcgtgtcgtgagatgttgggttaagtcccgcaacgagcgcaacccttgtccttagttgccagcacgtgaaggtggggactttaaggagactgccggtgataaaccggaggaaggtggggatgacgtcaaatcatcatgccccttatgagttgggctacacacgtactacaatggctggtacaaagggaagcgaacctgcgagggtaagcggaccccataaagccagtctaagttcggatcgcagtctgcaactcgactgcgtgaagtcggattcgctagtaatcgcagatcagaatgctgcggtgaatacgttcccgggtcttgtacacaccgcccgtcacaccacgagagtttataacacccaaagccggtggcttaaccgaggaatcggagggagccgtctaaggtgggataagcgattggggtgaagtcgtaacaaggtatccctaccggaaggtggggatggatcacctcctttctatggaga

SEQ ID NO: 2597 - DNA, 1488 bp, Chamaesiphon minutus
  ref <308>: DATABASE ACCESSION NUMBER: NCBI ACCESSION: NC_019697.1
  ref <309>: DATABASE ENTRY DATE: 2019-04-01
  ref <313>: RELEVANT RESIDUES IN SEQ ID NO: (1)..(1488)
attatggagagtttgatcctggctcaggatgaacgctggcggtatgcctaacacatgcaagtcgaacggtgtcttcggacatagtggcggacgggtgagtaacgcgtgagaatctgccttcaggacggggacaacagttggaaacgactgctaatacccgatgtgacgaaagttgaaagatttatcgcctgaagatgagctcgcgtcagattagctagatggtgtggtaaaggcgcaccatggcgacgatctgtagctggtctgagaggatgagcagccacactgggactgagacacggcccagactcctacgggaggcagcagtggggaattttccgcaatgggcgcaagcctgacggagcaataccgcgtgagggaggaaggctcttgggtcgtaaacctcttttcttagggaagaacaaaatgacggtacctaaggaatcagcatcggctaactccgtgccagcagccgcggtaatacggaggatgcaagcgttatccggaatgattgggcgtaaagcgtccgtaggtggttttgtaagtccgtggttaaagcgcgaagcttaacttcgtaagggccatggaaactacaagacttgagtaaagtaggggtagagggaattcccagtgtagcggtgaaatgcgtagagattgggaagaacaccggtggcgaaagcgctctactggacttaaactgacactgagggacgaaagctaggggagcgaaagggattagatacccctgtagtcctagccgtaaacgatggatactaggtgttgcccgtatcgacccgggcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaatttctgcgaaagtagaaagtgccttcgggaaccagaacacaggtggtgcatggctgtcgtcagctcgtgtcgtgagatgttgggttaagtcccgcaacgagcgcaaccctcgtttttagttgccatcattaagttgggcactctagaaagactgccggtgacaaaccggaggaaggtggggatgacgtcaagtcagcatgccccttacgccctgggctacacacgtactacaatgctatggacaaagagcagccaactggcgacagtgcgctaatctcataaaccatggctcagttcagattgcaggctgcaactcgcctgcatgaaggcggaatcgctagtaatcgcaggtcagcatactgcggtgaatccgttcccgggccttgtacacaccgcccgtcacaccatgggagttggtcacgcccgaagtcgttactctaaccgcaaggaagaggacgccgaaggtagggctgatgactggggtgaagtcgtaacaaggtagccgtaccggaaggtgtggctggatcacctcctttt

SEQ ID NO: 2598 - DNA, 1491 bp, Chamaesiphon polymorphus
  ref <308>: DATABASE ACCESSION NUMBER: NCBI ACCESSION: NZ_PVWO01000159.1
  ref <309>: DATABASE ENTRY DATE: 2019-04-01
  ref <313>: RELEVANT RESIDUES IN SEQ ID NO: (1)..(1491)
attatggagagtttgatcctggctcaggatgaacgctggcggtatgcctaacacatgcaagtcgaacgggtgtcttcggacattagtggcggacgggtgagtaacgcgtgagaatctgccttcaggatggggacaacagttggaaacgactgctaatacccgatatgacgaaagttgaaagatttatcgcctggagatgagctcgcgtcagattagctagatggtgtggtaaaggcgcaccatggcgacgatctgtagctggtctgagaggatgagcagccacactgggactgagacacggcccagactcctacgggaggcagcagtggggaattttccgcaatgggcgcaagcctgacggagcaataccgcgtgagggaggaaggctcttgggtcgtaaacctcttttctcagggaagaacaaaatgacggtacctgaggaatcagcatcggctaactccgtgccagcagccgcggtaatacggaggatgcaagcgttatccggaatgattgggcgtaaagcgtccgtaggtggttttgtaagtccgtggttaaagcgcgaagcttaacttcgtaagggccatggaaactacaagacttgagtaaagtaggggtagagggaattcccagtgtagcggtgaaatgcgtagagattgggaagaacaccggtggcgaaagcgctctactggacttaaactgacactgagggacgaaagctaggggagcgaaagggattagatacccctgtagtcctagccgtaaacgatggatactaggtgttgcccgtatcgacccgggcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaatctcggcgaaagttgagagtgccttcgggaaccagaacacaggtggtgcatggctgtcgtcagctcgtgtcgtgagatgttgggttaagtcccgcaacgagcgcaaccctcgtttttagttgccatcattaagttgggcactctagaaagactgccggtgacaaaccggaggaaggtggggatgacgtcaagtcagcatgccccttacgccctgggctacacacgtactacaatgctatggacaaagagcagccaactggcgacagtgcgctaatctcataaaccatggctcagttcagattgcaggctgcaactcgcctgcatgaaggcggaatcgctagtaatcgcaggtcagcatactgcggtgaatccgttcccgggccttgtacacaccgcccgtcacaccatgggagttggtcacgcccgaagtcgttactctaacccttgtggaagaggacgccgaaggtagggctgatgactggggtgaagtcgtaacaaggtagccgtaccggaaggtgtggctggatcacctcctttt

SEQ ID NO: 2599 - DNA, 1492 bp, Chelativorans sp. BNC1
  ref <308>: DATABASE ACCESSION NUMBER: NCBI ACCESSION: NC_008254.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgcccttcgggggaaagatttatcggggatggatgagcccgcgtcggattagctagttggtggggtaatggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcagcggggaagataatgacggtacccgcagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctctcatactggcaatctcgagtttgggagaggtgagtggaattccgagtgtagaggtgaaattcgtagatattcggaggaacaccagtggcgaaggcggctcactggcccaaaactgacgctgaggtgcgaaagcgtggggagcaaacaggattagataccctggtagtccacgccgtaaacgatggaagctagccgttggcaggtttacctgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggatacgagagatcgtatccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgatgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccgtaggggaacctgcggctggatcacctcctttctaagg

SEQ ID NO: 2600 - DNA, 1492 bp, Chelativorans sp. J32
  ref <308>: DATABASE ACCESSION NUMBER: NCBI ACCESSION: NZ_JAEQ01000018.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacacgtgggaatctacccagctctacggaataacccagggaaacttggactaataccgtatacggccgagaggcgaaagatttatcggagttggatgagcccgcgtcggattagctagttggtggggtaaaggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggggaagataatgacggtacccggagaagaagccccggctaacttcgtgccagcagccgcggtaatacgaagggggctagcgttgttcggaattactgggcgtaaagcgcacgtaggcggattgttaagtgaggggtgaaatcccggggctcaaccccggaactgcctctcatactggcaatctcgagtttgggagaggtgagtggaattccgagtgtagaggtgaaattcgtagatattcggaggaacaccagtggcgaaggcggctcactggcccaaaactgacgctgaggtgcgaaagcgtggggagcaaacaggattagataccctggtagtccacgccgtaaacgatggaagctagccgttggcaggtttacctgtcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatcccggtcgcggcctagagagatctaggccttcagttcggctggaccggtgacaggtgctgcatggctgtcgtcagctcgtgtcgtgagatgttgggttaagtcccgcaacgagcgcaaccctcgcccttagttgccatcattcagttgggcactctaaggggactgccggtgataagccgcgaggaaggtggggatgatgtcaagtcctcatggcccttacgggctgggctacacacgtgctacaatggtggtgacagtgggcagcgagaccgcgaggtcgagctaatctccaaaaaccatctcagttcggattgcactctgcaactcgagtgcatgaagttggaatcgctagtaatcgcggatcagcatgccgcggtgaatacgttcccgggccttgtacacaccgcccgtcacaccatgggagttgggtttacccgaaggcagtgcgctaaccgcaaggaggcagctgaccacggtaggctcagcgactggggtgaagtcgtaacaaggtagccgtaggggaacctgcggctggatcacctcctttctaagg

SEQ ID NO: 2601 - DNA, 1494 bp, Chelatococcus asaccharovorans
  ref <308>: DATABASE ACCESSION NUMBER: NCBI ACCESSION: NZ_QJJK01000001.1
  ref <309>: DATABASE ENTRY DATE: 2019-04-01
  ref <313>: RELEVANT RESIDUES IN SEQ ID NO: (1)..(1494)
caatctgagagtttgatcctggctcagagcgaacgctggcggcaggcttaacacatgcaagtcgaacgcatccttcggggtgagtggcagacgggtgagtaacacgtgggaacgtaccttttggttcggaacaactgagggaaacttcagctaataccggatacgcccttatggggaaagatttatcgccgaaagatcggcccgcgtctgattagctagttggtgaggtaatggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaagaataagccccggctaacttcgtgccagcagccgcggtaatacgaagggggctagcgttgctcggaatcactgggcgtaaagggcgcgtaggcggacatttaagtcaggggtgaaatcccggggctcaacctcggaattgcctttgatactgggtgtctcgagaccggaagaggtaagtggaactgcgagtgtagaggtgaaattcgtagatattcgcaagaacaccagtggcgaaggcggcttactggtccggttctgacgctgaggcgcgaaagcgtggggagcaaacaggattagataccctggtagtccacgccgtaaacgatggatgctagccgttggacagcttgctgttcagtggcgcagaaaactcattaagcatcccgcctggggagtacggtcgcaagattaaaactcaaaggaattgacgggggcccgcacaagcggtggagcatgtggtttaattcgaagcaacgcgcagaaccttaccagctcttgacatgtctcgtttggttaccggagacggtatccttcagttcggctggcgagaacacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggcggtgacaatgggcagcgaaggggcgacctggagctaatcccaaaaagccgtctcagttcggattgcactctgcaactcgagtgcatgaaggtggaatcgctagtaatcgcagatcagcatgctgcggtgaatacgttcccgggccttgtacacaccgcccgtcacaccatgggagttggttttacccgaaggcgttacgctaacccgcaagggaggcaggcgaccacggtagggtcagcgactggggtgaagtcgtaacaaggtagccgtaggggaacctgcggctggatcacctcctttctaag

SEQ ID NO: 2602 - DNA, 1496 bp, Chelatococcus daeguensis
  ref <308>: DATABASE ACCESSION NUMBER: NCBI ACCESSION: NZ_CP018095.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagagcgaacgctggcggcaggcctaacacatgcaagtcgaacggttccttcggggacagtggcagacgggtgagtaacgcgtgggaacgtgccctttggttcggaataactcagggaaacttgagctaataccggatacgtccgagaggagaaagatttatcgccgaaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctcttttatccgggacgataatgacggtaccggaagaataagccccggctaacttcgtgccagcagccgcggtaatacgaagggggctagcgttgctcggaatcactgggcgtaaagggcgcgtaggcggacgtttaagtcaggggtgaaatcccggggctcaacctcggaattgcctttgatactggatgtctcgagaccggaagaggtaagtggaactgcgagtgtagaggtgaaattcgtagatattcgcaagaacaccagtggcgaaggcggcttactggtccggatctgacgctgaggcgcgaaagcgtggggagcaaacaggattagataccctggtagtccacgccgtaaacgatggatgctagccgttgggcagcttgctgctcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagcccttgacatgtctcgtttggataccggagacggtttccttcagttcggctggcgagaacacaggtgctgcatggctgtcgtcagctcgtgtcgtgagatgttgggttaagtcccgcaacgagcgcaaccctcgcccctagttgccatcattcagttgggcactttagggggactgccggtgataagccgagaggaaggtggggatgacgtcaagtcctcatggcccttacgggctgggctacacacgtgctacaatggcggtgacaatgggcagcgaaagggcgacctggagctaatccccaaaagccgtctcagttcagattgcactctgcaactcgagtgcatgaaggcggaatcgctagtaatcgcagatcagcatgctgcggtgaatacgttcccgggccttgtacacaccgcccgtcacaccatgggagttggttctacccgaaggcgctgcgccaaccgcaagggggcaggcgaccacggtagggtcagcgactggggtgaagtcgtaacaaggtagccgtaggggaacctgcggctggatcacctcctttctaagga

SEQ ID NO: 2603 - DNA, 1496 bp, Chelatococcus sambhunathii; identical to SEQ ID NO: 2602
  ref <308>: DATABASE ACCESSION NUMBER: NCBI ACCESSION: NZ_CYHC01000015.1
  ref <309>: DATABASE ENTRY DATE: 2019-04-01
  ref <313>: RELEVANT RESIDUES IN SEQ ID NO: (1)..(1496)

SEQ ID NO: 2604 - DNA, 1496 bp, Chelatococcus sp. CO-6
  ref <308>: DATABASE ACCESSION NUMBER: NCBI ACCESSION: NZ_CP012398.1
  ref <309>: DATABASE ENTRY DATE: 2019-04-01
  ref <313>: RELEVANT RESIDUES IN SEQ ID NO: (1)..(1496)
ttcaacttgagagtttgatcctggctcagagcgaacgctggcggcaggcctaacacatgcaagtcgaacggttccttcggggacagtggcagacgggtgagtaacgcgtgggaacgtgcccttcggttcggaataactcagggaaacttgagctaataccggatacgtccgagaggagaaagatttatcgccgaaggatcggcccgcgtctgattagctagttggtgtggtaacggcgcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctcttttatccgggacgataatgacggtaccggaagaataagccccggctaacttcgtgccagcagccgcggtaatacgaagggggctagcgttgctcggaatcactgggcgtaaagggcgcgtaggcggacgtttaagtcaggggtgaaatcccggggctcaacctcggaattgcctttgatactggatgtctcgagaccggaagaggtaagtggaactgcgagtgtagaggtgaaattcgtagatattcgcaagaacaccagtggcgaaggcggcttactggtccggatctgacgctgaggcgcgaaagcgtggggagcaaacaggattagataccctggtagtccacgccgtaaacgatggatgctagccgttgggcagcttgctgttcagtggcgcagctaacgctttaagcatcccgcctggggagtacggtcgcaagattaaaactcaaaggaattgacgggggcccgcacaagcggtggagcatgtggtttaattcgaagcaacgcgcagaaccttaccagctcttgacatgtctcgtttgggttcgagagatcggacccttcagttcggctggcgagaacacaggtgctgcatggctgtcgtcagctcgtgtcgtgagatgttgggttaagtcccgcaacgagcgcaaccctcgcccctagttgccatcattcagttgggcactttagggggactgccggtgataagccgagaggaaggtggggatgacgtcaagtcctcatggcccttacgggctgggctacacacgtgctacaatggcggtgacaatgggcagcgaaagggcgacctggagctaatccccaaaagccgtctcagttcagattgtactctgcaactcgagtgcatgaaggcggaatcgctagtaatcgcagatcagcatgctgcggtgaatacgttcccgggccttgtacacaccgcccgtcacaccatgggagttggttctacccgaaggcgctgcgccaaccgcaaggaggcaggcgaccacggtagggtcagcgactggggtgaagtcgtaacaaggtagccgtaggggaacctgcggctggatcacctcctttctaagga

SEQ ID NO: 2605 - DNA, 1550 bp, Chitinivibrio alkaliphilus
  ref <308>: DATABASE ACCESSION NUMBER: NCBI ACCESSION: NZ_ASJR01000046.1
  ref <309>: DATABASE ENTRY DATE: 2019-04-01
  ref <313>: RELEVANT RESIDUES IN SEQ ID NO: (1)..(1550)
taatttatggagagtttgatcctggctcagagtgaacgctggcggagtgcttaatacatgcaagtcgagcgagaaagcttcttcggaagtgagtagagcggcgaacgggtgagtaacacgtaaataacctgtccttaagttcgggacaaccttgctaacgcgaggctaataccggatgtgaacataatgcagcattgtataatgtttaaaggctacctcttcatgaaagtggttgcttaagggtggatttgcgtaccattagttagttggtggggtaacggcctaccaagacgatgatggttagccgacctgagagggtgatcggccacattgggactgagacacggcccagactcctacgggaggcagcagtagggaatcttgcgcaatggacgaaagtctgacgcagcaactccgcgtggaggaagacggtcttcggattgtaaactcctttggtatgggaagaaaccctgtatgttaatagcatacagcttgacggtaccatactaaaaagtcacggctaaatacgtgccagcagccgcggtaatacgtatgtggcgagcgttactcggaatcactgggcgtaaagggtacgtaggctgatttctaagtcagtagtgaaatgtcggggcttaaccccggagttgctattgaaactggtaatcttgaatatgcgaggggaagacggaatttctggtgtagcggtggaatgcgtagatatcagaaagaacaccggcggcgaaggcggtcttctggcgcaatattgacgctgaggtacgaaagcgtggggagcgaacaggattagataccctggtagtccacgccgtaaacgatggacactagctggtggagatttcactggcgcagttaacgcattaagtgtcccgcctggggagtacgtccgcaaggatgaaacccaaaggaattgacgggggcccgcacaagcggtggagcatgtgctttaattcgatgcaacgcgaagaaccttacctggtcttgacataccagtgctacgtttagagatagacggttttcttcggaaacactggatacaggtgctgcatggttgtcgtcagctcgtgtcgtgagatgttgggttaagtcccgtaacgagcgcaacccttgtccttagttgccatcattaagttgggcactctatggagacagccgtcgcaaggcggaggaaggtgaggatgacgtcaaatcatcatggcccttacgaccagggctagacacgtgctacaatggccaatacaaagggtagctacatagcgatatggtgctaatctcaaaaagttggtcacagttcggatcggagtctgcaactcgactccgtgaagttggaatcgctagtaatcgtgggtcagcataccacggtgaatacgttcccgggccttgtacacaccgcccgtcaagccacgaaagttggtggtgcccgacatcgtatccttaaccattggaggggagcgactaaggcgacactgataattggggctaagtcgtaacaaggtagctgtatcggaagttgcagctggaacacctcctttctg

SEQ ID NO: 2606 - DNA, 1539 bp, Chitinophaga barathri
  ref <308>: DATABASE ACCESSION NUMBER: NCBI ACCESSION: NZ_RMBX01000024.1
  ref <309>: DATABASE ENTRY DATE: 2019-04-01
  ref <313>: RELEVANT RESIDUES IN SEQ ID NO: (1)..(1539)
acaatggagagtttgatcctggctcaggatgaacgctagcggcaggcctaatacatgcaagtcgaggggcagcgcaggtagcaatactgggcggcgaccggcaaacgggtgcggaacacgtacgcaaccttccttttagcggggaatagcccatagaaatgtggattaataccccttaagatcatgatccggcatcgggtagtgattaaagctccggcactagaagatgggcgtgcgtctgattaggtagttggtgaggtaatggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggaagaaatgctctttttctaaagggtttgacggtaccagatgaataagcaccggctaactccgtgccagcagccgcggtaatacggagggtgcaagcgttatccggattcactgggtttaaagggtgcgtaggcggaattgtaagtccgtggtgaaatctccgagcttaactcggaaactgccgtggatactatagttcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacaggattagataccctggtagtccacgccctaaacgatgattactcgacatttgcgatatacagcaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggaccgatcctgaaaggggtctttgtagcaatacaccgccagtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgcgaggaaggaggggatgatgtcaagtcatcatggcctttatgcccagggctacacacgtgctacaatggtaggaacaaagggctgctacctggtaacaggctgctaatctcaaaaatcctatctcagttcggattgagggctgcaactcgccctcatgaagctggaatcgctagtaatcgtatatcagcaatgatacggtgaatacgttcccggaccttgtacacaccgcccgtcaagccatgaaagccggggggacctgaagtcggcaaccgcaaggagccgcctagggtaaaatcggtaattggggctaagtcgtaacaaggtagccgtatcggaaggtgcggctggaatacctcctttttagagcacatt

SEQ ID NO: 2607 - DNA, 1537 bp, Chitinophaga caeni
  ref <308>: DATABASE ACCESSION NUMBER: NCBI ACCESSION: NZ_CP023777.1
  ref <309>: DATABASE ENTRY DATE: 2019-04-01
  ref <313>: RELEVANT RESIDUES IN SEQ ID NO: (1)..(1537)
tacaacggagagtttgatcctggctcaggatgaacgctagcggcaggcctaatacatgcaagtcgaggggcatcgcggcgtagcaatacgctggcggcgaccggcaaacgggtgcggaacacgtacgcaaccttcctccaggagcgggatagcccagggaaacttggattaataccgcgtaagaccgcgggccggcatcggcccgcggtgagagtaccaacgcctggagatgggcgtgcgcctgattaggtagttggcggggtaacggcccaccaagccgtcgatcagtaactggcgtgagagcgcgaccagtcacacgggcactgagacacgggcccgactcctacgggaggcagcagtaaggaatattggtcaatggacgcaagtctgaaccagccatgccgcgtggaggatgacggccctccgggttgtaaactccttttacacgggaagaaaggcggtttttctaaaccgtttgacggtaccgtgggaataagcaccggctaactccgtgccagcagccgcggtaatacggagggtgcgagcgttatccggattcactgggtttaaagggtgcgtaggcgggtctgtaagtccgtcgtgaaatccccgggcttaacccgggaactgcggtggatactacgggccttgaatactgcgggggccagcggaatatgtcatgtagcggtgaaatgcatagatatgacatagaacaccgatcgcgaaggcagctggctacacagtcattgacgctgaggcacgaaagcgtggggatcaaacaggattagataccctggtagtccacgccctaaacgatgattactcgacatacgcgatacactgcgtgtgtccgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgcgagctgcccgcccctgaaagggggccttgtagcaatacacggttcgcaaggtgctgcatggctgtcgtcagctcgtgccgtgaggtgttgggttaagtcccgcaacgagcgcaacccctatccctagttgccaacaggtcatgctgggaactctagggaaactgccgtcgcaagacgcgaggaaggaggggacgatgtcaagtcatcatggcctttatgcccagggctacacacgtgctacaatggtaggaacaaagggccgctacccggcaacgggttgccaatctcaaaaatcctatctcagttcggattgggggctgcaactcgcccccatgaagctggaatcgctagtaatcgtatatcagcaatgatacggtgaatacgttcccggaccttgtacacaccgcccgtcaagccatgaaagccggggggacctgaagtcggtaaccgcgaggatccgcctagggtaaaaccggtaattggggctaagtcgtaacaaggtagccgtatcggaaggtgcggctggaatacctcctttttagagc

SEQ ID NO: 2608 - DNA, 1542 bp, Chitinophaga dinghuensis
  ref <308>: DATABASE ACCESSION NUMBER: NCBI ACCESSION: NZ_QLMA01000021.1
  ref <309>: DATABASE ENTRY DATE: 2019-04-01
  ref <313>: RELEVANT RESIDUES IN SEQ ID NO: (1)..(1542)
tacaatggagagtttgatcctggctcaggatgaacgctagcggcaggcctaatacatgcaagtcgaggggcagcgcagtgtagcaatacatgggcggcgaccggcaaacgggtgcggaacacgtacgcaaccttccttcaagcggggaatagcccagagaaatttggattaataccccataagaatgtagtctggcatcagacagcatttaaagatttatcacttgaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaatgccctctgggttgtaaacttcttttatctgggacgaaacactctttttctaaggagcttgacggtaccagaggaataagcaccggctaactccgtgccagcagccgcggtaatacggagggtgcaagcgttatccggattcactgggtttaaagggtgcgtaggcggacttgtaagtccgtggtgaaatctccaagcttaacttggaaactgccatggatactataagtcttgaatgttgtggaggttagcggaatatgtcatgtagcggtgaaatgcttagatatgacatagaacaccgattgcgaaggcagctggctacacaactattgacgctgaggcacgaaagcgtggggatcaaacaggattagataccctggtagtccacgccctaaacgatggatactcgacatttgcgatacattgtaagtgtctgagcgaaagcattaagtatcccacctgggaagtacgaccgcaaggttgaaactcaaaggaattgacgggggtccgcacaagcggtggagcatgtggtttaattcgatgatacgcgaggaaccttacctgggctagaatgcagattgaccgtggatgaaagttcactttgtagcaatacacagtctgtaaggtgctgcatggctgtcgtcagctcgtgccgtgaggtgttgggttaagtcccgcaacgagcgcaacccctatcactagttgccagcacgtaatggtgggaactctagtgaaactgccgtcgtaagacgcgaggaaggaggggatgatgtcaagtcatcatggcctttatgcccagggctacacacgtgctacaatggtagagacaaagggctgctacttggtaacaagctgctaatctcaaaaactctatctcagttcggattgaggtctgcaactcgacctcatgaagctggaatcgctagtaatcgtatatcagcaatgatacggtgaatacgttcccggaccttgtacacaccgcccgtcaagccatgaaagtcggggggacctgaagtcggcaaccgcaaggaaccgcctagggtaaaatcgataattggggctaagtcgtaacaaggtagccgtatcggaaggtgcggctggaatacctcctttttagagctcatt

SEQ ID NO: 2609 - DNA, 1540 bp, Chitinophaga eiseniae
  ref <308>: DATABASE ACCESSION NUMBER: NCBI ACCESSION: NZ_FUWZ01000029.1
  ref <309>: DATABASE ENTRY DATE: 2019-04-01
  ref <313>: RELEVANT RESIDUES IN SEQ ID NO: (1)..(1540)
tacaatggagagtttgatcctggctcaggatgaacgctagcggcaggcctaatacatgcaagtcgaggggcagcatgggtagcaatacctgatggcgaccggcaaacgggtgcggaacacgtacgcaaccttccttcaagcggggaatagcccagagaaatttggattaataccccataggaatgtagtctcgcatgagacagcatttaaagatttatcacttgaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaaggccctctgggttgtaaacttcttttatttgggacgaaacactttctttctagagagcttgacggtaccagatgaataagcaccggctaactccgtgccagcagccgcggtaatacggagggtgcaagcgttatccggattcactgggtttaaagggtgcgtaggcggacttgtaagtccgtggtgaaatctccgagcttaactcggaaactgccatggatactataagtcttgaatgttgtggaggttagcggaatagttcatgtagcggtgaaatgcttagatatgacctagaacaccaattgcgaaggcagctggctacacaataattgacgctgaggcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgcaatttgaccggtcctgaaagggatttttgtagcaatacacagattgtaaggtgctgcatggctgtcgtcagctcgtgccgtgaggtgttgggttaagtcccgcaacgagcgcaacccctatcactagttgccagcacgtaatggtgggaactctagtgaaactgccgtcgtaagacgcgaggaaggaggggatgatgtcaagtcatcatggcctttatgcccagggctacacacgtgctacaatggtagagacaaagggctgctacctggtaacaggctgctaatctcaaaaactctatctcagttcggattgaggtctgcaactcgacctcatgaagctggaatcgctagtaatcgtatatcagcaatgatacggtgaatacgttcccggaccttgtacacaccgcccgtcaagccatgaaagccggggggacctgaagtcggtaaccgcaaggagccgcctagggtaaaaccggtaattggggctaagtcgtaacaaggtagccgtatcggaaggtgcggctggaatacctcctttttagagctcatt

SEQ ID NO: 2610 - DNA, 1540 bp, Chitinophaga ginsengisoli
  ref <308>: DATABASE ACCESSION NUMBER: NCBI ACCESSION: NZ_PYGK01000047.1
  ref <309>: DATABASE ENTRY DATE: 2019-04-01
  ref <313>: RELEVANT RESIDUES IN SEQ ID NO: (1)..(1540)
tacaatggagagtttgatcctggctcaggatgaacgctagcggcaggcctaatacatgcaagtcgaggggcagcacaggtagcaatactgggtggcgaccggcaaacgggtgcggaacacgtacgtaaccttcctttaagtgggagatagcccgaagaaattcggattaataccccataagattgtggagtggcatcactcagcaattaaagaatttcgcttaaagatgggcgtgcggctgattaggtagttggtgaggtaacggctcaccaagccaacgatcagtaactggcgtgagagcgcgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatatgggaagaaaccacttttttctaaaggtgttgacggtaccataggaataagcaccggctaactccgtgccagcagccgcggtaatacggagggtgcaagcgttatccggattcactgggtttaaagggtgcgtaggcggattagtaagtccgtggtgaaatctccgagcttaactcggaaactgccgtggatactattaatcttgaatactgtggaggttagcggaatatgtcatgtagcggtgaaatgcatagatatgacatagaacaccaattgcgaaggcagctggctacacagagattgacgctgaggcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggaccggatctgaaagggtcttttgtagcaatacaccgccagtaaggtgctgcatggctgtcgtcagctcgtgccgtgaggtgttgggttaagtcccgcaacgagcgcaacccctatctttagttgccaacaggtcaagctgggaactctaaagaaactgccgtcgtaagacgcgaggaaggaggggatgatgtcaagtcatcatggcctttatgcccagggctacacacgtgctacaatggtaggaacaaagggctgctacctggtaacaggatgctaatctcaaaaatcctatctcagttcgaattgagggctgcaactcgccctcatgaagctggaatcgctagtaatcgtatatcagcaatgatacggtgaatacgttcccggaccttgtacacaccgcccgtcaagccatgaaagccggggggacctgaagtcggtaaccgtaaggaaccgcctagggtaaaatcggtaattggggctaagtcgtaacaaggtagccgtatcggaaggtgcggctggaatacctcctttttagagctacatt

SEQ ID NO: 2611 - DNA, 1543 bp, Chitinophaga jiangningensis
  ref <308>: DATABASE ACCESSION NUMBER: NCBI ACCESSION: NZ_FRBL01000020.1
  ref <309>: DATABASE ENTRY DATE: 2019-04-01
  ref <313>: RELEVANT RESIDUES IN SEQ ID NO: (1)..(1543)
ttacaatggagagtttgatcctggctcaggatgaacgctagcggcaggcctaatacatgcaagtcgaggggcagcgcagtgtagcaatacatgggcggcgaccggcaaacgggtgcggaacacgtacgcaaccttccttcaagcggggaatagcccagagaaatttggattaataccccataagaatgtagtgaggcatctcacagcatttaaagatttatcacttgaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacggaagtctgaaccagccatgccgcgtggaggatgaaggtcctctggattgtaaacttcttttatctgggacgaaacacttcttttctaaggagcttgacggtaccagatgaataagcaccggctaactccgtgccagcagccgcggtaatacggagggtgcaagcgttatccggattcactgggtttaaagggtgcgtaggcggacttgtaagtccgtggtgaaatctccgagcttaactcggaaactgccatggatactataagtcttgaatgttgtggaggttagcggaatatgtcatgtagcggtgaaatgcttagatatgacatagaacaccgattgcgaaggcagctggctacacaactattgacgctgaggcacgaaagcgtggggatcaaacaggattagataccctggtagtccacgccctaaacgatggatactcgacatatgcgatacacagtatgtgtctgagcgaaagcattaagtatcccacctgggaagtacgaccgcaaggttgaaactcaaaggaattgacgggggtccgcacaagcggtggagcatgtggtttaattcgatgatacgcgaggaaccttacctgggctagaatgcagattgaccgtgggtgaaagctcactttgtagcaatacacagtctgtaaggtgctgcatggctgtcgtcagctcgtgccgtgaggtgttgggttaagtcccgcaacgagcgcaacccctatcactagttgccagcacgtaatggtgggaactctagtgaaactgccgtcgtaagacgcgaggaaggaggggatgatgtcaagtcatcatggcctttatgcccagggctacacacgtgctacaatggtagagacaaagggctgctacctggtaacaggctgctaatctcaaaaactctatctcagttcggattgaggtctgcaactcgacctcatgaagctggaatcgctagtaatcgtatatcagcaatgatacggtgaatacgttcccggaccttgtacacaccgcccgtcaagccatgaaagtcggggggacctgaagtcggcaaccgcaaggaaccgcctagggtaaaatcgataattggggctaagtcgtaacaaggtagccgtatcggaaggtgcggctggaatacctcctttttagagctcatt

SEQ ID NO: 2612 - DNA, 1541 bp, Chitinophaga niabensis
  ref <308>: DATABASE ACCESSION NUMBER: NCBI ACCESSION: NZ_FSRA01000005.1
  ref <309>: DATABASE ENTRY DATE: 2019-04-01
  ref <313>: RELEVANT RESIDUES IN SEQ ID NO: (1)..(1541)
ttacaatggagagtttgatcctggctcaggatgaacgctagcggcaggcctaatacatgcaagtcgaggggcagcacaggtagcaatactgggtggcgaccggcaaacgggtgcggaacacgtacgcaaccttcctttaagtggggaatagcccagagaaatttggattaataccccgtaatatcattgagaggcatcttttgatgattaaagctgaggcgcttaaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggaagaaatgtattttttctaaagtacttgacggtaccagatgaataagcaccggctaactccgtgccagcagccgcggtaatacggagggtgcaagcgttatccggattcactgggtttaaagggtgcgtaggcggatttttaagtccgtggtgaaatctccgagcttaactcggaaactgccatggatactatgagtcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacaggattagataccctggtagtccacgccctaaacgatgattactcgacatttgcgatacacagcaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggaccgtgggtgaaagctcactttgtagcaatacaccgccagtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgcgaggaaggaggggatgatgtcaagtcatcatggcctttatgcccagggctacacacgtgctacaatggtaggaacaaagggctgctacctggtaacaggctgctaatctcaaaaatcctatctcagttcggattgagggctgcaactcgccctcatgaagctggaatcgctagtaatcgtatatcagcaatgatacggtgaatacgttcccggaccttgtacacaccgcccgtcaagccatgaaagccggggggacctgaagtcggcaaccgcaaggagccgcctagggtaaaatcggtaattggggctaagtcgtaacaaggtagccgtatcggaaggtgcggctggaatacctcctttttagagcgcatt

SEQ ID NO: 2613 - DNA, 1540 bp, Chitinophaga niastensis
  ref <308>: DATABASE ACCESSION NUMBER: NCBI ACCESSION: NZ_PYAW01000028.1
  ref <309>: DATABASE ENTRY DATE: 2019-04-01
  ref <313>: RELEVANT RESIDUES IN SEQ ID NO: (1)..(1540)
tacaatggagagtttgatcctggctcaggatgaacgctagcggcaggcctaatacatgcaagtcgaggggcagcacaggtagcaatactgggtggcgaccggcaaacgggtgcggaacacgtacgcaaccttcctttaagcggggaatagcccagagaaatttggattaataccccataagaatgtggactggcatcagtcagcatttaaagatttatcacttaaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgagagtctgaaccagccatgccgcgtggaggatgaaggccctctgggttgtaaacttcttttatttgggacgaaacacttcttttctaagaagcttgacggtaccagatgaataagcaccggctaactccgtgccagcagccgcggtaatacggagggtgcaagcgttatccggattcactgggtttaaagggtgcgtaggcgggcatgtaagtccgtggtgaaatctctaagcttaacttggaaactgccatggatactatatgtcttgaatgttgtggaggttagcggaatatgtcatgtagcggtgaaatgcatagatatgacatagaacaccaattgcgaaggcagctggctacacaaatattgacgctgaggcacgaaagcgtggggatcaaacaggattagataccctggtagtccacgccctaaacgatgattactcgacatttgcgatacacagcaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgcagtctgactgtgggtgaaagctcattttgtagcaatacacagattgtaaggtgctgcatggctgtcgtcagctcgtgccgtgaggtgttgggttaagtcccgcaacgagcgcaacccctatcactagttgccagcacgtcaaggtgggaactctagtgaaactgccgtcgtaagacgcgaggaaggaggggacgatgtcaagtcatcatggcctttatgcccagggctacacacgtgctacaatggtgggaacaaagggctgctacctggtaacaggctgctaatctcaaaaatcccatctcagttcggattgaggtctgcaactcgacctcatgaagctggaatcgctagtaatcgtatatcagcaatgatacggtgaatacgttcccggaccttgtacacaccgcccgtcaagccatgaaagccggggggacctgaagtcggcaaccgcaaggaaccgcctagggtaaaatcggtaattggggctaagtcgtaacaaggtagccgtatcggaaggtgcggctggaatacctcctttttagagctcatt

SEQ ID NO: 2614 - DNA, 1538 bp, Chitinophaga parva
  ref <308>: DATABASE ACCESSION NUMBER: NCBI ACCESSION: NZ_QCYK01000007.1
  ref <309>: DATABASE ENTRY DATE: 2019-04-01
  ref <313>: RELEVANT RESIDUES IN SEQ ID NO: (1)..(1538)
tttacaatggagagtttgatcctggctcaggatgaacgctagcggcaggcctaatacatgcaagtcgaggggcagcacaggtagcaatactgggtggcgaccggcaaacgggtgcggaacacgtacgcaaccttccttgaagtgggggatagcccgaagaaattcggattaataccccgtagtatgttggagaggcatctttctaacattaaagctgaggcactttaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggaagaaatgtggtttatctaaatcatttgacggtaccagatgaataagcaccggctaactccgtgccagcagccgcggtaatacggagggtgcaagcgttatccggattcactgggtttaaagggtgcgtaggcggatctgtaagtcagtggtgaaatctccgggcttaacccggaaactgccgttgatactatagatcttgaatgttgtggaggttagcggaatatgtcatgtagcggtgaaatgcatagatatgacatagaacaccaattgcgaaggcagctggctacacaaatattgacgctgaggcacgaaagcgtggggatcaaacaggattagataccctggtagtccacgccctaaacgatggatactcgacatttgcgatatacagtaagtgtctgagcgaaagcattaagtatcccacctgggaagtacgaccgcaaggttgaaactcaaaggaattgacgggggtccgcacaagcggtggagcatgtggtttaattcgatgatacgcgaggaaccttacctgggctagaatgctggaggaccgtgggtgaaagctcactttgtagcaatacacctccagtaaggtgctgcatggctgtcgtcagctcgtgccgtgaggtgttgggttaagtcccgcaacgagcgcaacccctatctttagttgccaacaggtcaagctgggaactctaaagaaactgccgtcgtaagacgcgaggaaggaggggatgatgtcaagtcatcatggcctttatgcccagggctacacacgtgctacaatggtaggaacaaagggctgctacctggtaacaggatgctaatctcaaaaatcctatctcagttcggattgagggctgcaactcgccctcatgaagctggaatcgctagtaatcgtatatcagcaatgatacggtgaatacgttcccggaccttgtacacaccgcccgtcaagccatgaaagccggggggacctgaagtcggcaaccgcaaggaaccgcctagggtaaaatcggtaattggggctaagtcgtaacaaggtagccgtatcggaaggtgcggctggaatacctcctttttagagct

SEQ ID NO: 2615 - DNA, 1541 bp, Chitinophaga pinensis
  ref <308>: DATABASE ACCESSION NUMBER: NCBI ACCESSION: NC_013132.1
  ref <309>: DATABASE ENTRY DATE: 2019-04-01
  ref <313>: RELEVANT RESIDUES IN SEQ ID NO: (1)..(1541)
ttacaatggagagtttgatcctggctcaggatgaacgctagcggcaggcctaatacatgcaagtcgaggggcagcgcaggtagcaatactgggcggcgaccggcaaacgggtgcggaacacgtacgtaaccttcctctaaatggagcatagcccgaagaaattcggattaatactccataagattgtggagtggcatcactcagcaattaaagaatttcgtttagagatgggcgtgcggctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatgtgggaagaaaccactcctttctaggggtgttgacggtaccataggaataagcaccggctaactccgtgccagcagccgcggtaatacggagggtgcaagcgttatccggattcactgggtttaaagggtgcgtaggcgggtcagtaagtccgtggtgaaatctccaagcttaacttggaaactgccgtggatactattgaccttgaatgttgtggaggttagcggaatatgtcatgtagcggtgaaatgcttagatatgacatagaacaccaattgcgaaggcagctggctacacaaatattgacgctgaggcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggcccgatcctgaaagggatctttgtagcaatacaccgccagtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgcgaggaaggaggggatgatgtcaagtcatcatggcctttatgcccagggctacacacgtgctacaatggtaggaacaaagggctgctacctggtaacaggatgctaatctcaaaaatcctatctcagttcgaattgagggctgcaactcgccctcatgaagctggaatcgctagtaatcgtatatcagcaatgatacggtgaatacgttcccggaccttgtacacaccgcccgtcaagccatgaaagccggggggacctgaagtcggtaaccgtaaggaaccgcctagggtaaaatcggtaattggggctaagtcgtaacaaggtagccgtatcggaaggtgcggctggaatacctcctttttagagctacatt

SEQ ID NO: 2616 - DNA, 1542 bp, Chitinophaga rhizosphaerae
  ref <308>: DATABASE ACCESSION NUMBER: NCBI ACCESSION: NZ_RXLO01000028.1
  ref <309>: DATABASE ENTRY DATE: 2019-04-01
  ref <313>: RELEVANT RESIDUES IN SEQ ID NO: (1)..(1542)
tacaatggagagtttgatcctggctcaggatgaacgctagcggcaggcctaatacatgcaagtcgaggggcagcgcagtgtagcaatacatgggcggcgaccggcaaacgggtgcggaacacgtacgcaaccttccttcaagtgggggatagcccagagaaatttggattaataccccgtaagatggtggtctggcatcagacagccattaaagctgaggcgcttgaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatgtgggaagaaaccacctttttctaagggtgttgacggtaccataggaataagcaccggctaactccgtgccagcagccgcggtaatacggagggtgcaagcgttatccggattcactgggtttaaagggtgcgtaggcggaattgtaagtccgtggtgaaatctccaagcttaacttggaaactgccgtggatactatagttcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggcccgatcctgaaaggggtctttgtagcaatacaccgccagtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgcgaggaaggaggggatgatgtcaagtcatcatggcctttatgcccagggctacacacgtgctacaatggtaggaacaaagggctgctccctggtaacaggctgctaatctcaaaaatcctatctcagttcggattgagggctgcaactcgccctcatgaagctggaatcgctagtaatcgtatatcagcaatgatacggtgaatacgttcccggaccttgtacacaccgcccgtcaagccatgaaagccggggggacctgaagtcggcaaccgcaaggagccgcctagggtaaaatcggtaattggggctaagtcgtaacaaggtagccgtatcggaaggtgcggctggaatacctcctttttagagcgcatt

SEQ ID NO: 2617 - DNA, 1542 bp, Chitinophaga skermanii
  ref <308>: DATABASE ACCESSION NUMBER: NCBI ACCESSION: NZ_QLLL01000025.1
  ref <309>: DATABASE ENTRY DATE: 2019-04-01
  ref <313>: RELEVANT RESIDUES IN SEQ ID NO: (1)..(1542)
tacaatggagagtttgatcctggctcaggatgaacgctagcggcaggcctaatacatgcaagtcgaggggcagcgcagtgtagcaatacatgggcggcgaccggcaaacgggtgcggaacacgtacgcaaccttccttcaagagtgggatagcccagggaaacttggattaataccacgtaagatagtagagcggcatcgcttcgctattatagtaccaacgcttgaagatgggcgtgcggctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacggaagtctgaaccagccatgccgcgtgaaggatgactgccctctgggttgtaaacttcttttacatgggaagaaatgtgtgctttctagtgcatttgacggtaccatgggaataagcaccggctaactccgtgccagcagccgcggtaatacggagggtgcaagcgttatccggattcactgggtttaaagggtgcgtaggcgggtcagtaagtccgttgtgaaatctccgagcttaactcggaaactgcggtggatactattgaccttgaatgttgtggaggttagcggaatatgtcatgtagcggtgaaatgcatagatatgacatagaacaccaattgcgaaggcagctggctacacaactattgacgctgaggcacgaaagcgtggggatcaaacaggattagataccctggtagtccacgccctaaacgatggatactcgacatttgcgatatacagtaagtgtctgagcgaaagcattaagtatcccacctgggaagtacgaccgcaaggttgaaactcaaaggaattgacgggggtccgcacaagcggtggagcatgtggtttaattcgatgatacgcgaggaaccttacctgggctagaatgctagtagaccggtcctgaaagggatctttgtagcaatacactgctagtaaggtgctgcatggctgtcgtcagctcgtgccgtgaggtgttgggttaagtcccgcaacgagcgcaacccctatcattagttgccaacaggtcaagctgggaactctaatgaaactgccgtcgtaagacgcgaggaaggaggggatgatgtcaagtcatcatggcctttatgcccagggctacacacgtgctacaatggtaggaacaaagggctgctacctggtaacaagatgctaatctcaaaaatcctatctcagttcgaattgagggctgcaactcgccctcatgaagctggaatcgctagtaatcgtatatcagcaatgatacggtgaatacgttcccggaccttgtacacaccgcccgtcaagccatgaaagccggggggacctgaagtcggtaaccgcaaggagccgcctagggtaaaaccggtaattggggctaagtcgtaacaaggtagccgtatcggaaggtgcggctggaatacctcctttttagagcacatt

SEQ ID NO: 2618 - DNA, 1540 bp, Chitinophaga sp. GDMCC 1.1288
  ref <308>: DATABASE ACCESSION NUMBER: NCBI ACCESSION: NZ_QPMM01000024.1
  ref <309>: DATABASE ENTRY DATE: 2019-04-01
  ref <313>: RELEVANT RESIDUES IN SEQ ID NO: (1)..(1540)
tacaatggagagtttgatcctggctcaggatgaacgctagcggcaggcctaatacatgcaagtcgaggggcagcacaggtagcaatactgggtggcgaccggcaaacgggtgcggaacacgtacgcaaccttccttcaagcggggaatagcccagagaaatttggattaataccccataggaatgtggtctcgcatgagacagcatttaaagatttatcacttgaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaatgccctctgggttgtaaacttcttttatctgggacgaaacacttcctttctagggagcttgacggtaccaggtgaataagcaccggctaactccgtgccagcagccgcggtaatacggagggtgcaagcgttatccggattcactgggtttaaagggtgcgtaggcggatatgtaagtctgtggtgaaatctccgagcttaactcggaaactgccatggatactatatgtcttgaatgttgtggaggttagcggaatatgtcatgtagcggtgaaatgcttagatatgacatagaacaccgattgcgaaggcagctggctacacaactattgacgctgaggcacgaaagcgtggggatcaaacaggattagataccctggtagtccacgccctaaacgatggatactcgacatttgcgatatattgtaagtgtctgagcgaaagcattaagtatcccacctgggaagtacgaccgcaaggttgaaactcaaaggaattgacgggggtccgcacaagcggtggagcatgtggtttaattcgatgatacgcgaggaaccttacctgggctagaatgcagtctgactatggatgaaagttcattttgtagcaatacacagattgtaaggtgctgcatggctgtcgtcagctcgtgccgtgaggtgttgggttaagtcccgcaacgagcgcaacccctatcactagttgccagcacgtaatggtgggaactctagtgaaactgccgtcgtaagacgcgaggaaggaggggatgatgtcaagtcatcatggcctttatgcccagggctacacacgtgctacaatggtagagacaaagggctgctacttggtaacaagctgctaatctcaaaaactctatctcagttcggattgaggtctgcaactcgacctcatgaagctggaatcgctagtaatcgtatatcagcaatgatacggtgaatacgttcccggaccttgtacacaccgcccgtcaagccatgaaagccggggggacctgaagtcggcaaccgcaaggaaccgcctagggtaaaatcggtaattggggctaagtcgtaacaaggtagccgtatcggaaggtgcggctggaatacctcctttttagagctcatt

SEQ ID NO: 2619 - DNA, 1539 bp, Chitinophaga sp. GDMCC 1.1325
  ref <308>: DATABASE ACCESSION NUMBER: NCBI ACCESSION: NZ_QFFJ01000005.1
  ref <309>: DATABASE ENTRY DATE: 2019-04-01
  ref <313>: RELEVANT RESIDUES IN SEQ ID NO: (1)..(1539)
tacaatggagagtttgatcctggctcaggatgaacgctagcggcaggcctaatacatgcaagtcgaggggcagcgcaggtagcaatactgggcggcgaccggcaaacgggtgcggaacacgtacgcaaccttccttcaagcggggaatagcccagagaaatttggattaataccccataatactattgagaggcatcttttgatagttaaagatttatcacttgaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgaaagtctgaaccagccatgccgcgtggaggatgaaggccctctgggttgtaaacttcttttatctgggacgaaacacttcttttctaagaagcttgacggtaccagaggaataagcaccggctaactccgtgccagcagccgcggtaatacggagggtgcaagcgttatccggattcactgggtttaaagggtgcgtaggcggacttgtaagtccgtggtgaaatctccaggcttaacctggaaactgccatggatactatgagtcttgaatgttgtggaggttagcggaatagttcatgtagcggtgaaatgcttagatatgacctagaacaccaattgcgaaggcagctggctacacaacgattgacgctgaggcacgaaagcgtggggatcaaacaggattagataccctggtagtccacgccctaaacgatgattactcgacatttgcgatatattgtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgcagattgaccgtgggtgaaagctcattttgtagcaatacacagtctgtaaggtgctgcatggctgtcgtcagctcgtgccgtgaggtgttgggttaagtcccgcaacgagcgcaacccctatcactagttgccagcacttcgggtgggaactctagtgaaactgccgtcgtaagacgcgaggaaggaggggatgatgtcaagtcatcatggcctttatgcccagggctacacacgtgctacaatggtagagacaaagggctgctacctggtaacaggctgctaatctcaaaaactctatctcagttcggattgaggtctgcaactcgacctcatgaagctggaatcgctagtaatcgtatatcagcaatgatacggtgaatacgttcccggaccttgtacacaccgcccgtcaagccatgaaagccggggggacctgaagtcggtaaccgcaaggagccgcctagggtaaaaccggtaattggggctaagtcgtaacaaggtagccgtatcggaaggtgcggctggaatacctcctttttagagctcatt

SEQ ID NO: 2620 - DNA, 1535 bp, Chitinophaga sp. K20C18050901
  ref <308>: DATABASE ACCESSION NUMBER: NCBI ACCESSION: NZ_QTJV01000068.1
  ref <309>: DATABASE ENTRY DATE: 2019-04-01
  ref <313>: RELEVANT RESIDUES IN SEQ ID NO: (1)..(1535)
tacaatggagagtttgatcctggctcaggatgaacgctagcggcaggcctaatacatgcaagtcgaggggcagcgcaggtagcaatactgggcggcgaccggcaaacgggtgcggaacacgtacgcaaccttccttcaagagatggatagcccgaagaaattcggattaatacatcgtaaaatcacagagtggcatcacttcatgattaaagaatttcgcttgaagatgggcgtgcgcctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtgaaggatgaaggtcctctggatcgtaaacttcttttatctgggacgaaaccacctttttctaagggtgttgacggtaccagaggaataagcaccggctaactccgtgccagcagccgcggtaatacggagggtgcaagcgttatccggattcactgggtttaaagggtgcgtaggcggatttgtaagtccgtggtgaaatctccaggcttaacctggaaactgccatggatactataaatcttgaatgttgtggaggttagcggaatatgtcatgtagcggtgaaatgcatagatatgacatagaacaccaattgcgaaggcagctggctacacaaatattgacgctgaggcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgcagagtgaccgtgggtgaaagctcattttgtagcaatacacactttgtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgtgaggaaggaggggatgatgtcaagtcatcatggcctttatgcccagggctacacacgtgctacaatggtaggaacaaagggctgctacctggtaacaggatgctaatctcaaaaatcctatctcagttcgaattgagggctgcaactcgccctcatgaagctggaatcgctagtaatcgtatatcagcaatgatacggtgaatacgttcccggaccttgtacacaccgcccgtcaagccatgaaagccggggggacctgaagtcggtaaccgcaaggaaccgcctagggtaaaatcggtaattggggctaagtcgtaacaaggtagccgtatcggaaggtgcggctggaatacctcctttttagagct

SEQ ID NO: 2621 - DNA, 1539 bp, Chitinophaga sp. Mgbs1
  ref <308>: DATABASE ACCESSION NUMBER: NCBI ACCESSION: NZ_RIAR01000071.1
  ref <309>: DATABASE ENTRY DATE: 2019-04-01
  ref <313>: RELEVANT RESIDUES IN SEQ ID NO: (1)..(1539)
tacaatggagagtttgatcctggctcaggatgaacgctagcggcaggcctaatacatgcaagtcgaggggcagcacaggtagcaatactgggtggcgaccggcaaacgggtgcggaacacgtacgcaaccttccttcaagcgggggatagcccagagaaatttggattaataccccataggaatgtagtctcgcatgagacagcatttaaagatttattacttgaagatgggcgtgcgtctgattaggtagttggtgaagtaacggctcaccaagccgacgatcagtaactggcgtgagagcgcgaccagtcacacgggcactgagacacgggcccgactcctacgggaggcagcagtaaggaatattggtcaatggacgaaagtctgaaccagccatgccgcgtggaggatgaaggccctctgggttgtaaacttcttttatctgggacgaaacacttcctttctagggagcttgacggtaccaggtgaataagcaccggctaactccgtgccagcagccgcggtaatacggagggtgcaagcgttatccggattcactgggtttaaagggtgcgtaggcggacttgtaagtccgtggtgaaatctccgggcttaacccggaaactgccatggatactataagtcttgaatgttgtggaggttagcggaatatgtcatgtagcggtgaaatgcatagatatgacatagaacaccaattgcgaaggcagctggctacacaactattgacgctgaggcacgaaagcgtggggatcaaacaggattagataccctggtagtccacgccctaaacgatggatactcgacatttgcgatacacagcaagtgtctgagcgaaagcattaagtatcccacctgggaagtacgaccgcaaggttgaaactcaaaggaattgacgggggtccgcacaagcggtggagcatgtggtttaattcgatgatacgcgaggaaccttacctgggctagaatgcagtctgactgtgggtgaaagctcattttgtagcaatacacagattgtaaggtgctgcatggctgtcgtcagctcgtgccgtgaggtgttgggttaagtcccgcaacgagcgcaacccctatcactagttgccagcacttcgggtgggaactctagtgaaactgccgtcgtaagacgcgaggaaggaggggatgatgtcaagtcatcatggcctttatgcccagggctacacacgtgctacaatggtagagacaaagggctgctacctggtaacaggctgctaatctcaaaaactctatctcagttcggattgaggtctgcaactcgacctcatgaagctggaatcgctagtaatcgtatatcagcaatgatacggtgaatacgttcccggaccttgtacacaccgcccgtcaagccatgaaagccggggggacctgaagtcggcaaccgcaaggaaccgcctagggtaaaatcggtaattggggctaagtcgtaacaaggtagccgtatcggaaggtgcggctggaatacctcctttttagagctcatt

SEQ ID NO: 2622 - DNA, 1540 bp, Chitinophaga sp. S165
  ref <308>: DATABASE ACCESSION NUMBER: NCBI ACCESSION: NZ_QGTG01000029.1
  ref <309>: DATABASE ENTRY DATE: 2019-04-01
  ref <313>: RELEVANT RESIDUES IN SEQ ID NO: (1)..(1540)
tacaatggagagtttgatcctggctcaggatgaacgctagcggcaggcctaatacatgcaagtcgaggggcagcgcaggtagcaatactgggcggcgaccggcaaacgggtgcggaacacgtacgtaaccttcctttaagtgggagatagcccgaagaaattcggattaataccccataagattgtagagtggcatcacttagcaattaaagaatttcgcttaaagatgggcgtgcggctgattaggtagttggtgaggtaacggctcaccaagccaacgatcagtaactggcgtgagagcgcgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatgtgggaagaaaccacttctttctagaggtgttgacggtaccataggaataagcaccggctaactccgtgccagcagccgcggtaatacggagggtgcaagcgttatccggattcactgggtttaaagggtgcgtaggcggatttgtaagtccgtggtgaaatctccaagcttaacttggaaactgccatggatactataagtcttgaatattgtggaggttagcggaatatgtcatgtagcggtgaaatgcatagatatgacatagaacaccaattgcgaaggcagctggctacacaaatattgacgctgatgcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggaccggatctgaaagggtcctttgtagcaatacaccgccagtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgcgaggaaggaggggatgatgtcaagtcatcatggcctttatgcccagggctacacacgtgctacaatggtaggaacaaagggctgctacctggtaacaggatgctaatctcaaaaatcctatctcagttcgaattgagggctgcaactcgccctcatgaagctggaatcgctagtaatcgtatatcagcaatgatacggtgaatacgttcccggaccttgtacacaccgcccgtcaagccatgaaagccggggggacctgaagtcggtaaccgcaaggaaccgcctagggtaaaatcggtaattggggctaagtcgtaacaaggtagccgtatcggaaggtgcggctggaatacctcctttttagagctgcatt

SEQ ID NO: 2623 - DNA, 1541 bp, Chitinophaga sp. T22
  ref <308>: DATABASE ACCESSION NUMBER: NCBI ACCESSION: NZ_QXMH01000008.1
  ref <309>: DATABASE ENTRY DATE: 2019-04-01
  ref <313>: RELEVANT RESIDUES IN SEQ ID NO: (1)..(1541)
acaatggagagtttgatcctggctcaggatgaacgctagcggcaggcctaatacatgcaagtcgaggggcatcgcagggtagcaatacctgggcggcgaccggcaaacgggtgcggaacacgtacgcaaccttcctttaagcgggggatagcccatagaaatgtggattaataccccattagatcatggtccggcatcgggcagtgattaaagctccggcacttaaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggaagaaatgccgattttctaattggtttgacggtaccagatgaataagcaccggctaactccgtgccagcagccgcggtaatacggagggtgcaagcgttatccggattcactgggtttaaagggtgcgtaggcggaattgtaagtccgtggtgaaatctccaagcttaacttggaaactgccgtggatactatagttcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacaggattagataccctggtagtccacgccctaaacgatgattactcgacatacgcgatatacagtgtgtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggaccgggggtgaaagctccctttgtagcaatacaccgccagtaaggtgctgcatggctgtcgtcagctcgtgccgtgaggtgttgggttaagtcccgcaacgagcgcaacccctatctttagttgccaacaggtcaagctgggaactctaaagaaactgccgtcgtaagacgcgaggaaggaggggatgatgtcaagtcatcatggcctttatgcccagggctacacacgtgctacaatggtaggaacaaagggctgctacttggtaacaagctgctaatctcaaaaatcctatctcagttcggattgagggctgcaactcgccctcatgaagctggaatcgctagtaatcgtatatcagcaatgatacggtgaatacgttcccggaccttgtacacaccgcccgtcaagccatgaaagccggggggacctgaagtcggcaaccgcaaggagccgcctagggtaaaatcggtaattggggctaagtcgtaacaaggtagccgtatcggaaggtgcggctggaatacctcctttttagagcgcatt

SEQ ID NO: 2624 - DNA, 1542 bp, Chitinophaga sp. XJ-2
  ref <308>: DATABASE ACCESSION NUMBER: NCBI ACCESSION: NZ_QFFK01000012.1
  ref <309>: DATABASE ENTRY DATE: 2019-04-01
  ref <313>: RELEVANT RESIDUES IN SEQ ID NO: (1)..(1542)
ttacaatggagagtttgatcctggctcaggatgaacgctagcggcaggcctaatacatgcaagtcgaggggcagcgcagtgtagcaatacatgggcggcgaccggcaaacgggtgcggaacacgtacgcaaccttcctttaagtggggaatagcccagagaaatttggattaataccccgtaagatggtggtctggcatcagacagccattaaagctgaggcgcttaaagatgggcgtgcgtctgattaggtagttggtgaggtaatggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtgaaggatgaaggtcctctggattgtaaacttcttttatgtgggaagaaaccacctttttctaagggtgttgacggtaccataggaataagcaccggctaactccgtgccagcagccgcggtaatacggagggtgcaagcgttatccggattcactgggtttaaagggtgcgtaggcggaattgtaagtccgtggtgaaatctccaagcttaacttggaaactgccatggatactatagttcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctggtggaccggccctgaaaggggcttttgtagcaatacaccgccagtaaggtgctgcatggctgtcgtcagctcgtgccgtgaggtgttgggttaagtcccgcaacgagcgcaacccctatcattagttgccaacaggtaaagctgggaactctaatgaaactgccgtcgtaagacgcgaggaaggaggggatgatgtcaagtcatcatggcctttatgcccagggctacacacgtgctacaatggtaggaacaaagggctgctacctggtaacaggctgctaatctcaaaaatcctatctcagttcggattgagggctgcaactcgccctcatgaagctggaatcgctagtaatcgtatatcagcaatgatacggtgaatacgttcccggaccttgtacacaccgcccgtcaagccatgaaagccggggggacctgaagtcggcaaccgcaaggagccgcctagggtaaaatcggtaattggggctaagtcgtaacaaggtagccgtatcggaaggtgcggctggaatacctcctttttagagcgcat

SEQ ID NO: 2625 - DNA, 1541 bp, Chitinophaga sp. ZY74
  ref <308>: DATABASE ACCESSION NUMBER: NCBI ACCESSION: NZ_RPDH01000004.1
  ref <309>: DATABASE ENTRY DATE: 2019-04-01
  ref <313>: RELEVANT RESIDUES IN SEQ ID NO: (1)..(1541)
acaatggagagtttgatcctggctcaggatgaacgctagcggcaggcctaatacatgcaagtcgaggggcagcgcagtgtagcaatacatgggcggcgaccggcaaacgggtgcggaacacgtacgcaaccttcctttaagcggggaatagcccatagaaatgtggattaataccccttaatatcgtggtttggcatcagactacgattaaagctccggcacttaaagatgggcgtgcgtctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacgcaagtctgaaccagccatgccgcgtggaggatgaaggtcctctggattgtaaacttcttttatctgggaagaaatgccttttttctaaagggtttgacggtaccagatgaataagcaccggctaactccgtgccagcagccgcggtaatacggagggtgcaagcgttatccggattcactgggtttaaagggtgcgtaggcggaattgtaagtccgtggtgaaatctccgagcttaactcggaaactgccgtggatactatagttcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacaggattagataccctggtagtccacgccctaaacgatgattactcgacatttgcgatatacagtaagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgctgggggaccgggggtgaaagctccctttgtagcaatacaccgccagtaaggtgctgcatggctgtcgtcagctcgtgccgtgaggtgttgggttaagtcccgcaacgagcgcaacccctatctttagttgccaacaggttaagctgggaactctaaagaaactgccgtcgtaagacgcgaggaaggaggggatgatgtcaagtcatcatggcctttatgcccagggctacacacgtgctacaatggtaggaacaaagggctgctacctggtaacaggctgctaatctcaaaaatcctatctcagttcggattgagggctgcaactcgccctcatgaagctggaatcgctagtaatcgtatatcagcaatgatacggtgaatacgttcccggaccttgtacacaccgcccgtcaagccatgaaagccggggggacctgaagtcggcaaccgcaaggagccgcctagggtaaaatcggtaattggggctaagtcgtaacaaggtagccgtatcggaaggtgcggctggaatacctcctttttagagcgcatt

SEQ ID NO: 2626 - DNA, 1537 bp, Chitinophagaceae bacterium HBUM179779
  ref <308>: DATABASE ACCESSION NUMBER: NCBI ACCESSION: NZ_RCWL01000017.1
  ref <309>: DATABASE ENTRY DATE: 2019-04-01
  ref <313>: RELEVANT RESIDUES IN SEQ ID NO: (1)..(1537)
tacaatggagagtttgatcctggctcaggatgaacgctagcggcaggcttaatacatgcaagtcgaggggcagcacaggatagcaatatttgggtggcgaccggcaaacgggtgcggaacacgtacgcaaccttcctttaagtgtgggatagcccagggaaacttggattaataccacgtaagatagtagagtggcatcacttagctattatagctccggcgcttaaagatgggcgtgcggctgattaggtagttggcagggtaacggcctaccaagccttcgatcagtaactggtgtgagagcacgaccagtcacacgggcactgagacacgggcccgactcctacgggaggcagcagtaaggaatattggtcaatggacgcaagtctgaaccagccatgccgcgtgaaggatgacggccctctgggttgtaaacttcttttatctgggaagaaacctgcgatatctattgcagttgacggtaccaggtgaataagcaccggctaactccgtgccagcagccgcggtaatacggagggtgcaagcgttatccggattcactgggtttaaagggtgcgtaggcgggtatgtaagtcagtggtgaaatccccgagcttaacttgggaactgccgttgatactatatatcttgaatatcgtgtaggtaagcggaatatgtcatgtagcggtgaaatgcatagatatgacatggaacaccaattgcgaaggcagcttactttacgatgattgacgctgaggcacgaaagcgtgggtagcgaacaggattagataccctggtagtccacgccctaaacgatggatactcgaccttagcgatacaccgttagagtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgctggtagaccgtcggtgaaagccgattttgtagcaatacactgccagtaaggtgctgcatggctgtcgtcagctcgtgccgtgaggtgttgggttaagtcccgcaacgagcgcaacccccatcattagttgccatcaggttaagctgggaactctaatgaaactgccgtcgcaagacgtgaggaaggaggggatgatgtcaagtcatcatggcctttatgcccagggctacacacgtgctacaatggggaggacaaagagcagccacttggcaacaaggcgcaaatctcaaaaacctcttctcagttcagattggagtctgcaactcgactccatgaagctggaatcgctagtaatcgtatatcagcaatgatacggtgaatacgttcccggaccttgcacacaccgcccgtcaagccatggaagctgggtgtacctaaagtcggtaaccgcaaggagctgcctagggtaaaactagtgactggggctaagtcgtaacaaggtagccgtaccggaaggtgcggctggaatacctcctttttagagc

SEQ ID NO: 2627 - DNA, 1538 bp, Chitinophagaceae bacterium IBVUCB2
  ref <308>: DATABASE ACCESSION NUMBER: NCBI ACCESSION: NZ_NFUV01000002.1
  ref <309>: DATABASE ENTRY DATE: 2019-04-01
  ref <313>: RELEVANT RESIDUES IN SEQ ID NO: (1)..(1538)
tacaatggagagtttgatcctggctcaggatgaacgctagcggcaggcttaatacatgcaagtcgaggggcagctgactgtagcaatacattgatggcgaccggcaaacgggtgcggaacacgtacagaaccttccttcgagcggggaatagcccagagaaatttggattaataccccatagaactatgaagtggcatcactttatacttaaagatttatcacttgaagatggctgtgcggctgattaggtagttggcggggtaacggcccaccaagcctgcgatcagtagctggtgtgagagcatgatcagccacacgggcactgagacacgggcccgactcctacgggaggcagcagtaaggaatattggacaatggacgcaagtctgatccagccatgccgcgtgaaggattaaggtcctctggattgtaaacttcttttataagggacgaaaaaaggtctttctagatcgtctgacggtaccttatgaataagcaccggctaactccgtgccagcagccgcggtaatacggagggtgcaagcgttatccggattcactgggtttaaagggtgcgtaggcgggcaggtaagtcagtggtgaaatcctagagcttaactctagaactgccattgatactatctgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacaggattagataccctggtagtccacgccctaaacgatggatactcgacatacgcgatacactgtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcattttgaccgccagtgaaagctggttttgtagcaatacacaatttgtaaggtgctgcatggctgtcgtcagctcgtgccgtgaggtgttgggttaagtcccgcaacgagcgcaacccctatcaatagttgccaacaggtaatgctgggaactctattgaaactgccgccgtaaggcgtgaggaaggaggggatgatgtcaagtcatcatggcctttatgcccagggctacacacgtgctacaatggggtggacaaagggctgcaacacggtgacgtgaagctaatcccaaaaaacgcctctcagttcagattgtagtctgcaactcgactacgtgaagctggaatcgctagtaatcgtatatcagcaatgatacggtgaatacgttcccggaccttgcacacaccgcccgtcaagccatgggagtcgggtgtacctaaagtcggtaaccgcaaggagccgcctagggtaaaactagtgactggggctaagtcgtaacaaggtagccgtatcggaaggtgcggctggaatacctcctttttagagct

SEQ ID NO: 2628 - DNA, 1537 bp, Chitinophagaceae bacterium K23C18032701
  ref <308>: DATABASE ACCESSION NUMBER: NCBI ACCESSION: NZ_QTJU01000021.1
  ref <309>: DATABASE ENTRY DATE: 2019-04-01
  ref <313>: RELEVANT RESIDUES IN SEQ ID NO: (1)..(1537)
tacaatggagagtttgatcctggctcaggatgaacgctagcggcaggcttaatacatgcaagtcgaggggcatcaggatgtagcaatacattgctggcgaccggcaaacgggtgcggaacacgtacgcaacattcctctaactggaagatagcccagggaaacttggattaatattccataatataattggtcggcatcgattgattattaaagttccggcggttagagattggcgtgcgtctgattagatagttgggggggtaacggcccaccaagtcaacgatcagtagctgatgtgagagcatgatcagccacacgggcactgagacacgggcccgactcctacgggaggcagcagtaaggaatattggtcaatggacgcaagtctgaaccagccatgccgcgtgaaggatgaaggtcctctggattgtaaacttcttttatctggggcgaaacagtggatttctatctgccttgacagtaccagatgaataagcaccggctaactccgtgccagcagccgcggtaatacggagggtgcaagcgttatccggattcactgggtttaaagggtgcgtaggcgggcaggtaagtcagtggtgaaatcctggagcttaactccagaactgccattgatactatttgtcttgaatttcctggaggtcagcggaatatgtcatgtagcggtgaaatgcttagatatgacatagaacaccgattgcgaaggcagctgactacgggtgaattgacgctgaggcacgaaagcgtggggatcaaacaggattagataccctggtagtccacgccctaaacgatggatactcgacatacgcgatacacagtgtgtgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgcagtttgaccgtggatgaaagttcattttgtagcaatacacagactgtaaggtgctgcatggctgtcgtcagctcgtgccgtgaggtgttgggttaagtcccgcaacgagcgcaacccctatcattagttgccatcaggtaaagctgggaactctaatgaaactgccgtcgtaagacgcgaggaaggaggggatgatgtcaagtcatcatggcctttatgcccagggctacacacgtgctacaatggtaactacaaagagcagccacttggcgacaaggcgcgaatctcaaaaaagttatctcagttcagatcgcagtctgcaactcgactgcgtgaagctggaatcgctagtaatcgtatatcagcaatgatacggtgaatacgttcccggaccttgcacacaccgcccgtcaagccatgggagccgggtgtacctaaagtcggtaaccgaaaggatctgcctagggtaaaactggtgactggggctaagtcgtaacaaggtagccgtaccggaaggtgcggctggaatacctcctttttagagc

SEQ ID NO: 2629 - DNA, 1543 bp, Chitinophagaceae bacterium N24
  ref <308>: DATABASE ACCESSION NUMBER: NCBI ACCESSION: NZ_QOWJ01000029.1
  ref <309>: DATABASE ENTRY DATE: 2019-04-01
  ref <313>: RELEVANT RESIDUES IN SEQ ID NO: (1)..(1543)
tacaatggagagtttgatcctggctcaggatgaacgctagcggcaggcttaatacatgcaagtcgtggggcagcatggtgtgtagcaatacgcactgatggcgaccggcaaacgggtgcggaacacgtacgcaacttacccttaagtgggggatagcccggggaaacccggattaatacctcgtaacactgtgaagtggcatcactttatagttatagctccggcgcttaaggatgggcgtgcgtcccattaggtagttggttgaggtaacggctcaccaagcctgcgatgggtaactggtgtgagagcacgaccagtcacacgggcactgagacacgggcccgactcctacgggaggcagcagtaaggaatattggtcaatggacgcaagtctgaaccagccatgccgcgtggaggatgaaggccctctgggttgtaaacttcttttatgggggacgaaaccccggatttttatccggcctgacggtaccccaggaataagcaccggctaactccgtgccagcagccgcggtaatacggagggtgcaagcgttatccggattcactgggtttaaagggtgcgtaggcgggtttgtaagtcagtggtgaaatcccgaagcttaacttcggaactgccgttgatactacaggtcttgaatactcgggaggtgagcggaatatgtcatgtagcggtgaaatgcttagatatgacatagaacaccgattgcgaaggcagctcactacagagtcattgacgctgaggcacgaaagcgtggggatcaaacaggattagataccctggtagtccacgccctaaactatggatactcgacgtgtgcgatatgacagcatgcgtctgagcgaaagcattaagtatcccacctgggaagtacgaccgcaaggttgaaactcaaaggaattggcgggggtccgcacaagcggtggagcatgtggtttaattcgatgatacgcgaggaaccttacctgggctagaatgctgagtgaccgcgggtgaaagctcgttttatagcaatatacactcagtaaggtgctgcatggctgtcgtcagctcgtgccgtgaggtgttgggttaagtcccgcaacgagcgcaacccccatcagtagttgccatcaggtaacgctgggaactctactgaaactgccgtcgtaagacgcgaggaaggaggggatgatgtcaagtcatcatggcctttatgcccagggctacacacgtgctacaatggggcgtacaaagggctgccacttagcgataaggagccaatcccaaaaaacgcctctcagttcagatcgcagtctgcaactcgactgcgtgaagctggaatcgctagtaatcgtatatcagcaatgatacggtgaatacgttcccggaccttgcacacaccgcccgtcaagccatggaagccggggggacctgaagtcggtaaccgcaaggagccgcctagggtaagaccggtaactggggctaagtcgtaacaaggtagccgtatcggaaggtgcggctggaatacctcctttttagagc

SEQ ID NO: 2630 - DNA, 1554 bp, Chlamydia muridarum
  ref <308>: DATABASE ACCESSION NUMBER: NCBI ACCESSION: NZ_CP007217.1
  ref <309>: DATABASE ENTRY DATE: 2019-04-01
  ref <313>: RELEVANT RESIDUES IN SEQ ID NO: (1)..(1554)
ttttctgagaatttgatcttggttcagattgaacgctggcggcgtggatgaggcatgcaagtcgaacggaacaattgcttcggtgattgtttagtggcggaagggttagtaatgcatagataatttgtccttaacttgggaataacggttggaaacggccgctaataccgaatgtggcgtagattaggcatctaaattacgttaaagaaggggatcttcggacctttcggttaagggagagtctatgtgatatcagctagttggtggggtaaaggcctaccaaggctatgacgtctaggcggattgagagattggccgccaacactgggactgagacactgcccagactcctacgggaggctgcagtcgagaatctttcgcaatggacggaagtctgacgaagcgacgccgcgtgtgtgatgaaggctctagggttgtaaagcactttcgcttgggaataagagaagacggttaatacccgttggatttgagcgtaccaggtaaagaagcaccggctaactccgtgccagcagctgcggtaatacggagggtgctagcgttaatcggatttattgggcgtaaagggcgtgtaggcggaaaggtaagttagttgtcaaatctcggggctcaaccccgaatcggcatctaaaactatttttctagagggtagatggagaaaagggaatttcacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaaggaccttacctgggtttgacatgcatatgaccgcggcagaaatgtcgttttccgcaaggacatatgcacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgcccagggcgacacacgtgctacaatggccagtacagaaggtagcaagatcgcgagatggagcaaatcctcaaagctggccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacccgcaagggggagaggcgcccaaggtgaggctgatgactgggatgaagtcgtaacaaggtagccctaccggaaggtggggctggatcacctcctttt

SEQ ID NO: 2631 - DNA, 1561 bp, Chlamydia pneumoniae
  ref <308>: DATABASE ACCESSION NUMBER: NCBI ACCESSION: NZ_LN847241.1
  ref <309>: DATABASE ENTRY DATE: 2019-04-01
  ref <313>: RELEVANT RESIDUES IN SEQ ID NO: (1)..(1561)
ttttctgagaatttgatcttagttcagattgaacgctggcggcgtggatgaggcatgcaagtcgaacggaataatgacttcggttgttatttagtggcggaagggttagtagtacatagataatctgccctcaacttggggataacggttggaaacgatcgctaataccgaatgtagtgtaattaggcatctaatatatattaaagaaggggatcttcggacctttcggttgaggaagagtttatgcgatatcagcttgttggtggggtaaaagcccaccaaggcgatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggccttagggttgtaaagcactttcgcctgggaataagagagattggctaatatccaatcgatttgagcgtaccgggtaaagaagcaccggctaactccgtgccagcagctgcggtaatacggagggtgctagcgttaatcggatttattgggcgtaaagggcgtgtaggcggaaaggaaagttagatgttaaattttggggctcaaccccaagtcagcatttaaaactatctttctagaggatagatggggaaaagggaattccacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgtgttaagtatgccgcctgaggagtacactcgcaagggtgaaactcaaaagaattgacgggggcccgcacaagcagtggagcatgtggtttaattcgatgcaacgcgaaggaccttacctggacttgacatgtatttgacaactgtagaaatacagctttccgcaaggacagatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgtccagggcgacacacgtgctacaatggttagtacagaaggtagcaagatcgtgagatggagcaaatcctaaaagctagccccagttcggattgtagtctgcaactcgactacatgaagtcggaattgctagtaatggcgtgtcagccataacgccgtgaatacgttctcgggccttgtacacaccgcccgtcacatcatgggagttggttttaccttaagtcgttgactcaacctatttataggagagaggcgcccaaggtgaggctgatgactgggatgaagtcgtaacaaggtagccctaccggaaggtggggctggatcacctcctttttaagga

SEQ ID NO: 2632 - DNA, 1553 bp, Chlamydia psittaci
  ref <308>: DATABASE ACCESSION NUMBER: NCBI ACCESSION: NZ_CP033059.1
  ref <309>: DATABASE ENTRY DATE: 2019-04-01
  ref <313>: RELEVANT RESIDUES IN SEQ ID NO: (1)..(1553)
ttttctgagaatttgatcttggttcagattgaacgctggcggcgtggatgaggcatgcaagtcgaacggaataatgacttcggttattatttagtggcggaagggttagtaatacatagataatctgtcctcaacttgggaataacggttggaaacgaccgctaataccgaatgtggtatgtttaggcatctaaaacatattaaagaaggggatcttcggacctttcggttgagggagagtctatgggatatcagcttgttggtggggtaatggcctaccaaggctttgacgtctaggcggattgagagattgaccgccaacactgggactgagacactgcccagacttctacggaaggctgcagtcgagaatctttcgcaatggacgaaagtctgacgaagcgacgccgcgtgtgtgatgaaggctctagggttgtaaagcactttcgcttgggaataagagagattggctaatatccaatcgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaatcttggggctcaaccccaagccagcatctaatactatctttctagagggtagatggagaaaagggaattccacgtgtagcggtgaaatgcgtagatatgtggaagaacaccagtggcgaaggcgcttttctaatttacacctgacgctaaggcgcgaaagcaaggggagcaaacaggattagataccctggtagtccttgccgtaaacgatgcatacttgatgtggatagtctcaaccctatccgtgtcgtagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgcaaggacagatacacaggtgctgcatggctgtcgtcagctcgtgccgtgaggtgttgggttaagtcccgcaacgagcgcaacccttatcgttagttgccaacacttagggtgggaactctaacgagactgcctgggttaaccaggaggaaggcgaggatgacgtcaagtcagcatggcccttatgcccagggctacacacgtgctacaatggccagtacagaaggtagcaatatcgtgagatggagcaaatcctcaaagctggccccagttcggattgtagtctgcaactcgactacatgaagtcggaattgctagtaatggcgtgtcagctataacgccgtgaatacgttcccgggccttgtacacaccgcccgtcacatcatgggagttggttttgccttaagtcgttgactcaacctgcaaaggagagaggcgcccaaggtgaggctgatgactgggatgaagtcgtaacaaggtagccctaccggaaggtggggctggatcacctcctttt

SEQ ID NO: 2633 - DNA, 1557 bp, Chlamydia sp. H15-1957-10C
  ref <308>: DATABASE ACCESSION NUMBER: NCBI ACCESSION: NZ_LT993738.1
  ref <309>: DATABASE ENTRY DATE: 2019-04-01
  ref <313>: RELEVANT RESIDUES IN SEQ ID NO: (1)..(1557)
ttttctgagaatttgatcttggttcagattgaacgctggcggcgtggatgaggcatgcaagtcgaacggaataatgacttcggttgttatttagtggcggaagggttagtaatacatagataatctgccctcaacttgggaataacggttggaaacgatcgctaataccgaatgtagtgtatttaggcatctaatatatattaaagaaggggatcttcggacctttcggttgaggaagagtttatgcgatatcagcttgttggtggggtaaaagcctaccaaggctatgacgtctaggcggattgagagattgaccgccaacactgggactgagacactgcccagactcctacgggaggctgcagtcgagaatctttcgcaatggacgaaagtctgacgaagcgacgccgcgtgtgtgatgaaggccttagggttgtaaagcactttcgcctgggaataagagagattggctaatatccaatcaatttgagcgtaccaggtaaagaagcaccggctaactccgtgccagcagctgcggtaatacggagggtgctagcgttaatcggatttattgggcgtaaagggcgtgtaggcggaaaggaaagttagatgttaaattttggggctcaaccccaagtcagcatttaaaactatctttctagaggatagatggagaaaagggaattccacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgtgttaagtatgccgcctgaggagtacactcgcaagggtgaaactcaaaagaattgacgggggcccgcacaagcagtggagcatgtggtttaattcgatgcaacgcgaaggaccttacctggacttgacatgtatttgacagctgtagaaatacagtcttccgcaaggacagatacacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgtccagggcgacacacgtgctacaatggttagtacagaaggtagcaagatcgtgagatggagcaaatcctaaaagctaaccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacctatttataggagagaggcgcccaaggtgaggctgatgactgggatgaagtcgtaacaaggtagccctaccggaaggtggggctggatcacctccttttta

SEQ ID NO: 2634 - DNA, 1553 bp, Chlamydia sp. S15-834C
  ref <308>: DATABASE ACCESSION NUMBER: NCBI ACCESSION: NZ_LS992154.1
  ref <309>: DATABASE ENTRY DATE: 2019-04-01
  ref <313>: RELEVANT RESIDUES IN SEQ ID NO: (1)..(1553)
ttttctgagaatttgatcttggttcagattgaacgctggcggcgtggatgaggcatgcaagtcgaacggaataatgacttcggttattatttagtggcggaagggttagtaatacatagataatctgtcctcaacttgggaataacggttggaaacgaccgctaataccgaatgtggtatgtttaggcatctaaaacatattaaagaaggggatcttaggacctttcggttaaggaagagtctatgggatatcagcttgttggtggggtaatggcctaccaaggctttgacgtctaggcggattgagagattgaccgccaacactgggactgagacactgcccagacttctacggaaggctgcagtcgagaatctttcgcaatggacgaaagtctgacgaagcgacgccgcgtgtgtgatgaaggctctagggttgtaaagcactttcgcttgggaataagagaaattggctaatatccaattgatttgagcgtaccaggtaaagaagcaccggctaactccgtgccagcagctgcggtaatacggagggtgctagcgttaatcggatttattgggcgtaaagggcgtgtaggcggaaaggaaagttagatgttaaatcttggggctcaaccccaagccagcatctaatactatctttctagagggtagatggagaaaagggaattccacgtgtagcggtgaaatgcgtagatatgtggaagaacaccagtggcgaaggcgcttttctaatttacacctgacgctaaggcgcgaaagcaaggggagcaaacaggattagataccctggtagtccttgccgtaaacgatgcatacttgatgtggatagtctcaaccctatccgtgtcgtagctaacgcgttaagtatgccgcctgaggagtacactcgcaagggtgaaactcaaaagaattgacgggggcccgcacaagcagtggagcatgtggtttaattcgatgcaacgcgaagaaccttacctgggcttgacatgtatttgaccgcggcagaaatgtcgttttccgcaaggacaaatacacaggtgctgcatggctgtcgtcagctcgtgccgtgaggtgttgggttaagtcccgcaacgagcgcaacccttatcgttagttgccaacacttagggtgggaactctaacgagactgcctgggttaaccaggaggaaggcgaggatgacgtcaagtcagcatggcccttatgcccagggccacacacgtgctacaatggccagtacagaaggtagcaatatcgcgagatggagcaaatcctcaaagctggccccagttcggattgtagtctgcaactcgattacatgaagtcggaattgctagtaatggcgtgtcagctataacgccgtgaatacgttcccgggccttgtacacaccgcccgtcacatcatgggagttggttttgccttaagtcgttgactcaacctgcaaaggagagaggcgcccaaggtgaggctgatgactgggatgaagtcgtaacaaggtagccctaccggaaggtggggctggatcacctcctttt

SEQ ID NO: 2635 - DNA, 1554 bp, Chlamydia trachomatis
  ref <308>: DATABASE ACCESSION NUMBER: NCBI ACCESSION: NZ_CP035484.1
  ref <309>: DATABASE ENTRY DATE: 2019-04-01
  ref <313>: RELEVANT RESIDUES IN SEQ ID NO: (1)..(1554)
ttttctgagaatttgatcttggttcagattgaacgctggcggcgtggatgaggcatgcaagtcgaacggagcaattgtttcggcaattgtttagtggcggaagggttagtaatgcatagataatttgtccttaacttgggaataacggttggaaacggccgctaataccgaatgtggcgatatttgggcatccgagtaacgttaaagaaggggatcttaggacctttcggttaagggagagtctatgtgatatcagctagttggtggggtaaaggcctaccaaggctatgacgtctaggcggattgagagattggccgccaacactgggactgagacactgcccagactcctacgggaggctgcagtcgagaatctttcgcaatggacggaagtctgacgaagcgacgccgcgtgtgtgatgaaggctctagggttgtaaagcactttcgcttgggaataagagaaggcggttaatacccgctggatttgagcgtaccaggtaaagaagcaccggctaactccgtgccagcagctgcggtaatacggagggtgctagcgttaatcggatttattgggcgtaaagggcgtgtaggcggaaaggtaagttagttgtcaaagatcggggctcaaccccgagtcggcatctaatactatttttctagagggtagatggagaaaagggaatttcacgtgtagcggtgaaatgcgtagatatgtggaagaacaccagtggcgaaggcgcttttctaatttatacctgacgctaaggcgcgaaagcaaggggagcaaacaggattagataccctggtagtccttgccgtaaacgatgcatacttgatgtggatggtctcaaccccatccgtgtcggagctaacgcgttaagtatgccgcctgaggagtacactcgcaagggtgaaactcaaaagaattgacgggggcccgcacaagcagtggagcatgtggtttaattcgatgcaacgcgaaggaccttacctgggtttgacatgcatatgaccgcggcagaaatgtcgttttccgcaaggacatatgcacaggtgctgcatggctgtcgtcagctcgtgccgtgaggtgttgggttaagtcccgcaacgagcgcaacccttatcgttagttgccagcacttagggtgggaactctaacgagactgcctgggttaaccaggaggaaggcgaggatgacgtcaagtcagcatggcccttatgcccagggcgacacacgtgctacaatggccagtacagaaggtagcaagatcgtgagatggagcaaatcctyaaagctggccccagttcggattgtagtctgcaactcgactacatgaagtcggaattgctagtaatggcgtgtcagccataacgccgtgaatacgttcccgggccttgtacacaccgcccgtcacatcatgggagttggttttaccttaagtcgttgactcaacccgcgagggggagaggcgcccaaggtgaggctgatgactaggatgaagtcgtaacaaggtagccctaccggaaggtggggctggatcacctcctttt

SEQ ID NO: 2636 - DNA, 1505 bp, Chlorobaculum limnaeum
  ref <308>: DATABASE ACCESSION NUMBER: NCBI ACCESSION: NZ_CP017305.1
  ref <309>: DATABASE ENTRY DATE: 2019-04-01
  ref <313>: RELEVANT RESIDUES IN SEQ ID NO: (1)..(1505)
caacggagagtttgatcctggctcaggacgaacgctggcggcgtgcctaacacatgcaagtcaaagtctgagtggcttcggtcacaaggacttggcgcaagggtgagtaaggcataggtaatctgccttttggactgggacaaccccgagaaatcggggacaataccagatgatgcagcggaaccgcatggttatgttgttaaatgatttatcgccaaaagatgagcctatgttccatcaggtagttggtagggtaacggcttaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaaatccttttgcaggggacgaataggtcggcttgccggctgtgacggtaccctgcgaataagccacggctaactctgtgccagcagccgcggtgatacaggggtggcaagcgttgtccggatttactgggtgtaaagggtgcgcaggcggatcaataagtcgggggttaaatccatgtgcttaacacatgcacggcttccgatactgttgatctagagtctcgaagaggaaggtggaatttccggtgtaacggtggaatgtgtagatatcggaaagaacaccagtggcgaaggcagccttctggtcgagtactgacgctcatgcacgaaagcgtggggagcaaacaggattagataccctggtagtccacgccgtaaacgatgaatactagatgttggacatattgttcagtgtcgcagctaacgcgttaagtattccacctgggaagtacgcccgcaagggtgaaactcaaaggaattgacgggggcccgcacaagcggtggatcatgtggtttaattcgatgcaacgcgaagaaccttacctaggcttgatattgcagctaaactccctgaaaggggaggtccttcgggaagctgtaacaggtgctgcatggctgtcgtcagctcgtgtcgtgagatgttgggttaagtcccgcaacgagcgcaacccctacaattagttaccatcaggttatgctggggactctaattgaactgcctacgcaagtagagaggaaggaggggatgacgtcaagtcctcatggcccttacgcctagggccacacacgtgatacaatggcgactacagagggcaaagccgcaaggcagagggaatcccaaaaaagtcgtctcagtccggatcggagtctgcaactcgactccgtgaagttggaatcgctagtaatcgcggatcagcatgccgcggtgaatgtgttcccgggccttgtacacaccgcccgtcaagtcatggaagtcaggagtacccaaagacacgtgagtgtttaaggtaagactggtaactgggactaagtcgtaacaaggtagccgtaccggaaggtgcggctggatcacctccttttag

SEQ ID NO: 2637 - DNA, 1507 bp, Chlorobaculum parvum
  ref <308>: DATABASE ACCESSION NUMBER: NCBI ACCESSION: NC_011027.1
  ref <309>: DATABASE ENTRY DATE: 2019-04-01
  ref <313>: RELEVANT RESIDUES IN SEQ ID NO: (1)..(1507)
ttacaacggagagtttgatcctggctcaggacgaacgctggcggcgtgcctaacacatgcaagtcaaaggaaagtttcttcggaaataagtacttggcgcaagggtgagtaaggcataggtaatctgccctttggactggcataaccccgagaaatcggggacaataccagatgatgcagcggaaccgcatggttatgttgttaaatgatttatcgccaaaggatgagcctatgttccatcaggtagttggtagggtaacggcctaccaagccaacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaaatccttttgctggggacgaataggtcggcttgccgactctgacggtacccagcgaataagccacggctaactctgtgccagcagccgcggtgatacaggggtggcaagcgttgtccggatttactgggtgtaaagggtgcgcaggcggactgataagtcgggggttaaatccatgtgctcaacacatgcacggcttccgatactgtcagtcttgagtctcgaagaggaagatggaatttccggtgtaacggtggaatgtgtagatatcggaaagaacaccagtggcgaaggcagtcttctggtcgagtactgacgctcaggcacgaaagcgtggggagcaaacaggattagataccctggtagtccacgccgtaaacgatgaatactagatgttggtcatattgatcagtgtcgcagctaacgcattaagtattccacctgggaagtacgcccgcaagggtgaaactcaaaggaattgacgggggcccgcacaagcggtggatcatgtggtttaattcgatgcaacgcgaagaaccttacctaggcttgaaatgttagctaaagctcctgaaagggagtgtccttcggggagctagcacaggtgctgcatggctgtcgtcagctcgtgtcgtgagatgttgggttaagtcccgcaacgagcgcaacccctacaattagttactaacaggttaagctgaggactctaattgaactgcctacgcaagtagagaggaaggaggggatgacgtcaagtcctcatggcccttacgcctagggccacacacgtgatacaatggcgactacagagggcaaagccgcgaggcagaggaaatcccttaaaagtcgtctcagtccggatcggagtctgcaactcgactccgtgaagttggaatcgctagtaatcgcggatcagcatgccgcggtgaatgtgttcccgggccttgtacacaccgcccgtcaagtcatggaagtcaggagtacccaaagacgctcgcgcgtttaaggtaagactggtaactgggactaagtcgtaacaaggtagccgtaccggaaggtgcggctggatcacctccttttag

SEQ ID NO: 2638 - DNA, 1505 bp, Chlorobaculum sp. 24CR
  ref <308>: DATABASE ACCESSION NUMBER: NCBI ACCESSION: NZ_SDGU01000071.1
  ref <309>: DATABASE ENTRY DATE: 2019-04-01
  ref <313>: RELEVANT RESIDUES IN SEQ ID NO: (1)..(1505)
acaacggagagtttgatcctggctcaggacgaacgctggcggcgtgcctaacacatgcaagtcaaaggaaagtagcttcggttatgagtacttggcgcaagggtgagtaaggcataggtaatctgccctttggactggcataacctcgagaaatcgaggacaataccagatgatgcagcggaaccgcatggttatgttgttaaatgatttatcgccaaaggatgagcctatgttccatcaggtagttggtagggtaatggcctaccaagccaacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaaatccttttgcaggggacgaatcggtcggcttgccgactctgacggtaccctgcgaataagccacggctaactctgtgccagcagccgcggtgatacaggggtggcaagcgttgtccggatttactgggtgtaaagggtgcgcaggcggaccgataagtcgggggttaaatccatgtgcttaacacatgcacggcttccgatactgtcggtcttgagtctcgaagaggaagatggaatttccggtgtaacggtggaatgtgtagatatcggaaagaacaccagtggcgaaggcagtcttctggtcgagaactgacgctcaggcacgaaagcgtggggagcaaacaggattagataccctggtagtccacgccgtaaacgatgaatactagatgttggacatattgttcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctaggcttgatattgcagctaaagctcctgaaagggagtgtccttcgggaagctgtaacaggtgctgcatggctgtcgtcagctcgtgtcgtgagatgttgggttaagtcccgcaacgagcgcaacccctacaattagttaccatcaggttaagctggggactctaattgaactgcctacgcaagtagagaggaaggaggggatgacgtcaagtcctcatggcccttacgcctagggccacacacgtgatacaatggcgactacaaagggcaaagccgcgaggcagaggaaatcccaaaaaagtcgtctcagtccggatcggagtctgcaactcgactccgtgaagttggaatcgctagtaatcgcagatcagcatgctgcggtgaatgtgttcccgggccttgtacacaccgcccgtcaagtcatggaagtcaggagtacccaaagacgctcgcgcgtttaaggtaagactggtaactgggactaagtcgtaacaaggtagccgtaccggaaggtgcggctggatcacctccttttag

SEQ ID NO: 2639 - DNA, 1449 bp, Chlorobaculum tepidum
  ref <308>: DATABASE ACCESSION NUMBER: NCBI ACCESSION: NC_002932.3
  ref <309>: DATABASE ENTRY DATE: 2019-04-01
  ref <313>: RELEVANT RESIDUES IN SEQ ID NO: (1)..(1449)
caacggagagtttgatcctggctcaggacgaacgctggcggcgtgcctaacacatgcaagtcaaagtttgagtaacttcggttacaaagacttggcgcaagggtgagtaaggcataggtaatctgccttttggtctgggataaccccgagaaatcgggaacaataccagatgatgcagcggaatcgcatggttatgttgttaaagatttatcgccaaaagatgagcctatgttccatcaggtagttggtagggtaacggcctaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaaatccttttgcaggagacgaagaggtcggcttgccggctgtgacggtaccctgcgaataagccacggctaactctgtgccagcagccgcggtgatacaggggtggcaagcgttgtccggatttactgggtgtaaagggtgcgcaggcggatcgataagtcgggggttaaatccatgtgcttaacacatgcacggcttccgatactgttgatctagagtctcgaagaggaaggtggaatttccggtgtaacggtggaatgtgtagatatcggaaagaacaccagtggcgaaggcagccttctggtcgagtactgacgctcaggcacgaaagcgtggggagcaaacaggattagataccctggtagtccacgccgtaaacgatgaatactagatgttggtcatagtgatcagtgtcgcagctaacgcgttaagtattccacctgggaagtacgcccgcaagggtgaaactcaaaggaattgacgggggcccgcacaagcggtggatcatgtggtttaattcgatgcaacgcgaagaaccttacctaggcttgatattacagctaaacctcctgaaagggagggtccttcggggagctgtaacaggtgctgcatggctgtcgtcagctcgtgtcgtgagatgttgggttaagtcccgcaacgagcgcaacccctacaattagttaccatcaggttaagctggggactctaattgaactgcctacgcaagtagagaggagggaggggatgacgtcaagtcctcatggcccttacgcctagggccacacacgtgatacaatggcgactacagagggcaaagccgcaaggcagagggaatcccaaaaaagtcgtctcagtccggatcggagtctgcaactcgactccgtgaagttggaatcgctagtaatcgcggatcagcatgccgcggtgaatgtgttcccgggccttgtacacaccgcccgtcaagtcatggaagtcaggagtacccaaagacgctcgcgcgtttaaggtaagactggtaactgggac

SEQ ID NO: 2640 - DNA, 1506 bp, Chlorobium chlorochromatii
  ref <308>: DATABASE ACCESSION NUMBER: NCBI ACCESSION: NC_007514.1
  ref <309>: DATABASE ENTRY DATE: 2019-04-01
  ref <313>: RELEVANT RESIDUES IN SEQ ID NO: (1)..(1506)
tacaacggagagtttgatcctggctcaggacgaacgctggcggcgtgcctaacacatgcaagtcaaagggaagtgacttcggttatgagtacttggcgcaagggtgagtaacgtataggtaatttgccttttggactgaaataactccgagaaatcggagacaatgtcagatgatgcagcggaaccgcatggttatgttgttaaagatttatcgccaaaagatgagcctatatcccatcaggtagttggtagggtaaaagcctaccaagcctacgacgggtagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgcagggtaagaaactctcggtttaccgagactgacggtactctgcgaataagccacggctaactctgtgccagcagccgcggtgatacaggggtggcaagcgttgtccggatttactgggtgtaaagggtgcgcaggcgggctcgtaagtcgggggttaaatccgtgtgcttaacacacgcatggcttccgatactgcgagtctagagtatcgaagaggaagatggaatttccggtgtaacggtggaatgtgtagatatcggaaagaacaccagtggcgaaggcagtcttctggtcggttactgacgctcaggcacgaaagcgtggggagcaaacaggattagataccctggtagtccacgccgtaaacgatgaatactagatgttggtcatgttgatcagtgtcgcagctaacgcgttaagtattccacctgggaagtacgcccgcaagggtgaaactcaaaggaattgacgggggcccgcacaagcggtggatcatgtggtttaattcgatgcaacgcgaagaaccttacctgggcttgatatgctaactaaagtcgctgaaaggcgatgtccttcggggagttagtacaggtgctgcatggctgtcgtcagctcgtgtcgtgagatgttgggttaagtcccgcaacgagcgcaacccctacagttagttactaacaggtcaagctgaggactctaactgaactgcctacgcaagtagtgaggaaggaggggatgacgtcaagtcctcatggcccttacgcccagggccacacacgtgatacaatggtagctacagagggcaaagccgcaaggtggaggaaatcccttaaaagctatctcagtccggatcggagtctgcaactcgactccgtgaagttggaatcgctagtaatcgcagatcagcatgctgcggtgaatctgttcccgggccttgtacacaccgcccgtcaagtcatggaagttaggagtacccaaagacacgtgagtgtttaaggtaagactagtaactgggactaagtcgtaacaaggtagccgtaccggaaggtgcggctggatcacctccttttaat

SEQ ID NO: 2641 - DNA, 1519 bp, Chlorobium ferrooxidans
  ref <308>: DATABASE ACCESSION NUMBER: NCBI ACCESSION: NZ_AASE01000013.1
  ref <309>: DATABASE ENTRY DATE: 2019-04-01
  ref <313>: RELEVANT RESIDUES IN SEQ ID NO: (1)..(1519)
caagattaaactctacaacggagagtttgatcctggctcaggacgaacgctggcggcgtgcctaacacatgcaagtcaaagggaagcatcttcggatgtaagtacttggcgcaagggtgagtaatgtataggtaatctgccctttggactgggataaccccgagaaatcggggacaataccagatgatgcagcggaaccgcatggttatgttgttaaagatttatcgccaaaggatgaacctatatcccatcaggtagttggcagggttaaagcctaccaagcctacgacgggtagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgtagaggaagaatatcccggtttaccgggactgacggtactctgcgaataagccacggctaactctgtgccagcagccgcggtgatacaggggtggcaagcgttgtccggatttactgggtgtaaagggtgcgcaggcgggccgataagtcgggggttaaatccatgtgcttaacacatgcatggcttccgatactgtcggcctagagtctcgaagaggaagatggaatttccggtgtaacggtggaatgtgtagatatcggaaagaacaccagtggcgaaggcagtcttctggtcgagaactgacgctcaggcacgaaagcgtggggagcaaacaggattagataccctggtagtccacgccgtaaacgatgaatactagatgttggtaatttttatcagtgtcgcagctaacgcgttaagtattccacctgggaagtacgcccgcaagggtgaaactcaaaggaattgacgggggcccgcacaagcggtggatcatgtggtttaattcgatgcaacgcgaagaaccttacctgggcttgatattgcaactaaacctcctgaaagggagggtgcttcggcgagttgtaacaggtgctgcatggctgtcgtcagctcgtgtcgtgagatgttgggttaagtcccgcaacgagcgcaacccctacaattagttactaacaggttaagctgaggactctaattgaactgcctacgcaagtagtgaggaaggaggggatgacgtcaagtcctcatggcccttacgcccagggccacacacgtgatacaatggtagctacagagggcaaagccgcgaggcagagttaatcccttaaaagctatctcagtccggatcggagtctgcaactcgactccgtgaagttggaatcgctagtaatcgcggatcagcatgccgcggtgaatgtgttcccgggccttgtacacaccgcccgtcaagtcatggaagtcaggagcacccaaagacactcgcgtgtttaaggtgagactggtaactgggactaagtcgtaacaaggtagccgtaccggaaggtgcggctggatcacctccttttaat

SEQ ID NO: 2642 - DNA, 1504 bp, Chlorobium limicola
  ref <308>: DATABASE ACCESSION NUMBER: NCBI ACCESSION: NZ_LMBR01000120.1
  ref <309>: DATABASE ENTRY DATE: 2019-04-01
  ref <313>: RELEVANT RESIDUES IN SEQ ID NO: (1)..(1504)
caacggagagtttgatcctggctcaggacgaacgctggcggcgtgcctaacacatgcaagtcaaagggaagcgacttcggtcgtgagtacttggcgcaagggtgagtaacgtataggtaatctgccctttggactgggataacctcgagaaatcgaggacaataccagatgatgcagcgggaccgcatggtcatgttgttaaagatttatcgccaaaggatgagcctatattccatcaggtagttggtagggtaacggcctaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaaatccttttgcagaggaagaaaatgctggtttaccggcactgacggtactctgcgaataagccacggctaactctgtgccagcagccgcggtgatacaggggtggcaagcgttgtccggatttactgggtgtaaagggtgcgcaggcggacttataagtcgggggttaaatccatgtgcttaacacatgcaaggcttccgatactgtaggtctagagtctcgaagaggaagatggaatttccggtgtaacggtggaatgtgtagatatcggaaagaacaccagtggcgaaggcagtcttctggtcgagtactgacgctcaggcacgaaagcgtggggagcaaacaggattagataccctggtagtccacgccgtaaacgatgaatactagatgttggtcatattgatcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctgggcttgatattgcagctaaactcattgaaagatgaggtccttcgggaagctgtaacaggtgctgcatggctgtcgtcagctcgtgtcgtgagatgttgggttaagtcccgcaacgagcgcaacccctacaattagttactaacaggttaagctgaggactctaattgaactgcctacgcaagtagtgaggaaggaggggatgacgtcaagtcctcatggcccttacgcccagggccacacacgtgatacaatggtagctacagagggcaaagccgcgaggcagaggaaatcccaaaaaagctatctcagtccggatcggagtctgcaactcgactccgtgaagttggaatcgctagtaatcgcagatcagcacgctgcggtgaatgtgttcccgggccttgtacacaccgcccgtcaagtcatggaagtcaggagtacccaaagacgctcgcgcgtttaaggtaagactggtaactgggactaagtcgtaacaaggtagccgtaccggaaggtgcggctggatcacctccttttaat

SEQ ID NO: 2643 - DNA, 1507 bp, Chlorobium phaeobacteroides
  ref <308>: DATABASE ACCESSION NUMBER: NCBI ACCESSION: NC_010831.1
  ref <309>: DATABASE ENTRY DATE: 2019-04-01
  ref <313>: RELEVANT RESIDUES IN SEQ ID NO: (1)..(1507)
ttacaacggagagtttgatcctggctcaggacgaacgctggcggcgtgcctaacacatgcaagtcaaaggaaaacagcttcggctgcaagtacttggcgcaagggtgagtaaggtataggtaatttgcctacaggacagggataaccccgagaaatcggggacaatacctgatgatgcagcggaaccgcatggttatgttgttaaatgaggaatcgcctgtagataagcctatattccatcaggtagttggcggggtaaaagcccaccaagcctacgacggatagctggtctgagaggatgatcagccacattggaactgagacacggtccagactcctacgggaggcagcagtgaggaatattgcgcaatgggcgaaagcctgacgcagcaacgccgcgtggatgaagaagttcttcggaatgtaaagtccttttgtagaggaagaatagcctgttttacgggtgtgacggtactctgcgaataagccacggctaactctgtgccagcagccgcggtgatacaggggtggcaagcgttgtccggatttactgggtgtaaagggtgcgcaggcggaaaaatcagtcgggggttaaatccatatgctcaacatatgcatggcttccgatactgtttttctagagtgtcgaagaggaagatggaatttccggtgtaacggtggaatgtgtagatatcggaaagaacaccagtggcgaaggcagtcttctggtcgacaactgacgctcaggcacgaaagcgtggggagcaaacaggattagataccctggtagtccacgccgtaaacgatgaatactagatgttggtcatacgtgatcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctgggcttgacatgccggctaaactccctgaaaggggaggtccttcgggaagccggtgcaggtgctgcatggctgtcgtcagctcgtgtcgtgagatgttgggttaagtcccgcaacgagcgcaacccctacaattagttgctagcaggtaaagctgaggactctaattgaactgcctacgcaagtagagaggaaggaggggatgacgtcaagtcctcatggcccttacgtccagggctacacacgtgatacaatggcgactacaaagggcaaagccgcgaggtggaggaaatcccttaaaagtcgtcctagtccggatcggagtctgcaactcgactccgtgaagctggaatcgctagtaatcgtagatcagcatgctacggtgaatatgttcccgggccttgtacacaccgcccgtcaagtcatggaagtcgggagtacccgaagacgcgtatgcgtttaaggtaagaccggtaactgggactaagtcgtaacaaggtagccgtaccggaaggtgcggctggatcacctccttttag

SEQ ID NO: 2644 - DNA, 1505 bp, Chlorobium phaeovibrioides
  ref <308>: DATABASE ACCESSION NUMBER: NCBI ACCESSION: NZ_RXYJ01000027.1
  ref <309>: DATABASE ENTRY DATE: 2019-04-01
  ref <313>: RELEVANT RESIDUES IN SEQ ID NO: (1)..(1505)
acaacggagagtttgatcctggctcaggacgaacgctggcggcgtgcctaacacatgcaagtcaaagggaagcagcttcggctgtgagtacttggcgcaagggtgagtaatgtataggtaatctgcccttaggactggcataacctcgagaaatcgaggacaataccagatgatgcagcgggaccgcatggtcatgttgttaaagatttatcgcctaaggatgaacctatatcccatcaggtagttggcaggataatagcctaccaagcctacgacgggtagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgtagaggaagaacatgtcggtttaccggcactgacggtactctgcgaataagccacggctaactctgtgccagcagccgcggtgatacaggggtggcaagcgttgtccggatttactgggtgtaaagggtgcgcaggcggacttataagtcgggggttaaatccatgtgcttaacacatgcatggcttccgatactgtaagtctagagtctcggagaggaagatggaatttccggtgtaacggtggaatgtgtagatatcggaaagaacaccagtggcgaaggcagtcttctggccgagtactgacgctcaggcacgaaagcgtggggagcaaacaggattagataccctggtagtccacgccgtaaacgatgaatactagatgttggtcatattgatcagtgtcgcagctaacgcgttaagtattccacctgggaagtacgctcgcaagagtgaaactcaaaggaattgacgggggcccgcacaagcggtggatcatgtggtttaattcgatgcaacgcgaagaaccttacctgggcttgatattgcgactaaacctcctgaaagggagggtccttcggggagtcgtaacaggtgctgcatggctgtcgtcagctcgtgtcgtgagatgttgggttaagtcccgcaacgagcgcaacccctacaattagttactaacaggtcaagctgaggactctaattgaactgcctacgcaagtagtgaggaaggaggggatgacgtcaagtcctcatggcccttacgcccagggccacacacgtgatacaatggcagctacagagggcaaagccgcgaggtggaggaaatcccttaaaagctgtctcagtccggatcggagtctgcaactcgactccgtgaagttggaatcgctagtaatcgcagatcagcatgctgcggtgaatgtgttcccgggccttgtacacaccgcccgtcaagtcatggaagtcaggagtacccaaagacactcgcgtgtttaaggtaagactggtaactgggactaagtcgtaacaaggtagccgtaccggaaggtgcggctggatcacctccttttaat

SEQ ID NO: 2645 - DNA, 1519 bp, Chlorobium sp. KB01
  ref <308>: DATABASE ACCESSION NUMBER: NCBI ACCESSION: NZ_MPJE01000067.1
  ref <309>: DATABASE ENTRY DATE: 2019-04-01
  ref <313>: RELEVANT RESIDUES IN SEQ ID NO: (1)..(1519)
caagattaaactctacaacggagagtttgatcctggctcaggacgaacgctggcggcgtgcctaacacatgcaagtcaaagggaagcaacttcggttgtgagtacttggcgcaagggtgagtaaagtataggtaatctgccctttggactgggataaccccgagaaatcggggacaataccagatgatgcagcggaaccgcatggttatgttgttaaagatttatcgccaaaggatgaacctatatcccatcaggtagttggcagggttaaagcctaccaagcctacgacgggtagctggtctgagaggatgatcagccacattggaactgagacacggtccagactcctacgggaggcagcagtgaggaatattgcgcaatgggcgaaagcctgacgcagcaacgccgcgtggatgatgaagttcttcggaatgtaaagtccttttgtagaggaagaatatcccggtttaccgggactgacggtactctgcgaataagccacggctaactctgtgccagcagccgcggtgatacaggggtggcaagcgttgtccggatttactgggtgtaaagggtgcgcaggcggacttataagtcgggggttaaatccatgtgcttaacacatgcatggcttccgatactgtaagtctagagtctcgaagaggaagatggaatttccggtgtaacggtggaatgtgtagatatcggaaagaacaccagtggcgaaggcagtcttctggtcgagaactgacgctcaggcacgaaagcgtggggagcaaacaggattagataccctggtagtccacgccgtaaacgatgaatactagatgttggtaatttttatcagtgtcgcagctaacgcgttaagtattccacctgggaagtacgcccgcaagggtgaaactcaaaggaattgacgggggcccgcacaagcggtggatcatgtggtttaattcgatgcaacgcgaagaaccttacctgggcttgatattgcaactaaacctcctgaaagggagggtgcttcggcgagttgtaacaggtgctgcatggctgtcgtcagctcgtgtcgtgagatgttgggttaagtcccgcaacgagcgcaacccctacaattagttactaacaggttaagctgagaactctaattgaactgcctacgcaagtagtgaggaaggaggggatgacgtcaagtcctcatggcccttacgcccagggccacacacgtgatacaatggtagctacagagggcaaagccgcgaggcagagttaatcccttaaaagctatctcagtccggatcggagtctgcaactcgactccgtgaagttggaatcgctagtaatcgcggatcagcatgccgcggtgaatgtgttcccgggccttgtacacaccgcccgtcaagtcatggaagtcaggagcacccaaagacactcgcgtgtttaaggtgagactggtaactgggactaagtcgtaacaaggtagccgtaccggaaggtgcggctggatcacctccttttaat

SEQ ID NO: 2646 - DNA, 1486 bp, Chloroflexus aggregans
  ref <308>: DATABASE ACCESSION NUMBER: NCBI ACCESSION: NC_011831.1
  ref <309>: DATABASE ENTRY DATE: 2019-04-01
  ref <313>: RELEVANT RESIDUES IN SEQ ID NO: (1)..(1486)
atgtagagtttgatcctggctcaggacgaacgctggcggcgtgcctaatgcatgcaagtcgaacgcagcggccaagtgccggctgcgtggcgaacggctgaggaacacgtgggtcaccacccccggagtgggggataccccgtcgaaagacgggacaatcccgcatacgctctacggaggaaagccatacggcgctccgggacgggcctgcggcccatcaggtagttggtgtggtaacggcgcaccaagccactgacgggtacccggtctgagaggacggccgggcagactgggactgcgacacggcccagactcctacgggaggcagcagcaaggaattttccccaatgggcgcacgcctgagggagtaacgccgcgtggaggacgacggccttcgggttgtaaactcctttcgggtgggacgagactgacggtaccaccagaagcagccccggctaactctgtgccagcagccgcggtaagacagagggggcaagcgttgtccggagttactgggcgtaaagggcgcggaggcggtctgctgcgtcggcgctgaaagcgccccgcttaacggggcgaggcgcgccgatacgagcaggctggaggcgagcagagggtggtggaattccgggtggagcggtgaaatgcgtagagatccggaggaacgccggtggagcagtcggccacctgggctcgacctgacgctgcggcgcgaccgcgtggggagcaaaccggattagatacccgggtagtccacgccgtaaacgatgccggctcggcgtttggcgcgcgtgagcgtgctgggtgccttagctaacgcggtaagccggccgcctggggactacgagcgcaagcttaaaactcaaaggaattgacgggggcccgcacaagcagcggagcgtgtggtttaattcgacgcaacccgaagaaccttacccgggcttgacatgacgctgcaggcgcgggaaaccgcgcggcctttgagggtgcgtcacaggtgctgcatggctgtcgtcagctcgtgtcgtgagatgttgggttcagtcccgcaacgagcgcaacccgcgtcggtagttaccggtgtctaccgagactgccgccgagaccggcggaggaaggcgcggatgacgtcaagtcagcatggccctgacgtccggggcgacacacacgctacaatggccacgacaatgcgttgccacgccgcaaggcggcgctaatcgccaaacgtggtctcagtgcagatcgggggctgcaactcgcccccgtgaaggcggagttgctagtaaccgcgtatcagccatggcgcggtgaatacgttcccgggccttgtacacaccgcccgtcacgtcatgggagtggctaatgcttgaagtccgtgtgctaaccccccacggggaggcagcggccgagggcaggagccgcgactgggacgaagtcgtaacaaggtagccgtaccggaaggtgcggctggatcacctcctttcta

SEQ ID NO: 2647 - DNA, 1487 bp, Chloroflexus aurantiacus
  ref <308>: DATABASE ACCESSION NUMBER: NCBI ACCESSION: NC_012032.1
  ref <309>: DATABASE ENTRY DATE: 2019-04-01
  ref <313>: RELEVANT RESIDUES IN SEQ ID NO: (1)..(1487)
aatgtagagtttgatcctggctcaggacgaacgctggcggcgtgcctaatgcatgcaagtcgaacgcagcaggcgtgcctggctgcgtggcgaacggctgaggaacacgtgggtgacctgccccggagtgggggataccccgtcgaaagacgggacaatcccgcatacgctcgacggaggaaagccgcaaggcgctctgggaggggcctgcggcccatcaggtagttggtgtggtaacggcgcaccaagccaatgacgggtacccggtctgagaggacgaccgggcagactgggactgagacacggcccagactcctacgggaggcagcagcaaggaattttccccaatgggcgcaagcctgagggagcaacgccgcgtggaggacgacggccttcgggttgtaaactcctttcgggtgggacgatgctgacggtaccaccagaagcagccccggctaactctgtgccagcagccgcggtaagacagagggggcaagcgttgtccggagttactgggcgtaaagggcgcgcaggcggtgggctgcgtcggcgctgaaagcgccccgcttaacggggcgaggcgcgccgatacgagtccactcgaggcaagcagagggtggcggaattccgggtggagcggtgaaatgcgtagagatccggaggaacgccggtggggaagccggccacctgggcttgacctgacgctgcggcgcgacagcgtggggagcaaaccggattagatacccgggtagtccacgccgtaaacgatgccggctcggcgtctggcgcacgttggtgtgctgggtgccttagctcacgcggtaagccggccgcctggggactacgagcgcaagcttaaaactcaaaggaattgacgggggcccgcacaagcagcggagcgtgtggtttaattcgacgcaacacgaagaaccttacccggacttgacatggtgctgcatcccctggaaacaggggcgcctttgagggtgcaccacaggtgctgcatggctgtcgtcagctcgtgtcgtgagatgttgggttcagtcccgcaacgagcgcaacccgtgtcggtagttacaggtgtctaccgagactgccgccgtgaccggcggaggaaggcgcggatgacgtcaagtcagcatggcccttacgtccggggcgacacacacgctacaatggccacgacaatgcgttgccaagccgcaaggtggagctaatcgcctaaacgtggtctcagtgcagatcgggggctgcaactcgcccccgtgaaggcggagttgctagtaaccgcgtatcagccatggcgcggtgaatacgttcccgggccttgtacacaccgcccgtcacgtcatgggagtggccaatgcttgaagtccgtgtgctaaccccagtcggggaggcagcggccgagggcaggggccgcgactgggacgaagtcgtaacaaggtagccgtaccggaaggtgcggctggatcacctcctttcta

SEQ ID NO: 2648 - DNA, 1486 bp, Chloroflexus islandicus
  ref <308>: DATABASE ACCESSION NUMBER: NCBI ACCESSION: NZ_LWQS01000112.1
  ref <309>: DATABASE ENTRY DATE: 2019-04-01
  ref <313>: RELEVANT RESIDUES IN SEQ ID NO: (1)..(1486)
tgtagagtttgatcctggctcaggacgaacgctggcggcgtgcctaatgcatgcaagtcgaacgcagcggccttggccggctgcgtggcgaacggctgaggaacacgtgggtcaccacccccggagtgggggataccccgtcgaaagacgggacaatcccgcatacgctctacggaggaaagccgcaaggcgctccgggacgggcctgcggcccatcaggtagttggtgtggtaacggcgcaccaagccaatgacgggtccccggtctgagaggacgaccgggcagactgggactgcgacacggcccagactcctacgggaggcagcagcaaggaattttccccaatgggcgaaagcctgagggagcaacgccgcgtggaggacgacggccttcgggttgtaaactcctttcgggcgggacgatgatgacggtaccgccagaagcagccccggctaactctgtgccagcagccgcggtaagacagagggggcaagcgttgtccggagttactgggcgtaaagggcgcggaggcggtctgctgcgtcggcgctgaaagcgccccgcttaacggggcgaggcgcgccgatacgagcaggctggaggcgagcagagggcggcggaattccgggtggagcggtgaaatgcgtagagatccggaggaacgccagtggagaagtcggccgcctgggctcgacctgacgctgcggcgcgacagcgtggggagcaaaccggattagatacccgggtagtccacgccgtaaacgatgccggctcggcgtttggcgcgctcgcgcgcgctgggcgccttagctcacgcggtaagccggccgcctggggactacgagcgcaagcttaaaactcaaaggaattgacgggggcccgcacaagcagcggagcgtgtggtttaattcgacgcaacacgaagaaccttacccgggcttgacatgacgctgcaggcgtgggaaaccacgcggcctacgagggtgcgtcacaggtgctgcatggctgtcgtcagctcgtgtcgtgagatgttgggttcagtcccgcaacgagcgcaacccgcgtcggtagttacccgtgtctaccgagactgccgccgtgaccggcggaggaaggcgcggatgacgtcaagtcagcatggcccttacgtccggggcgacacacacgctacaatggccacgacaatgcgttgccaagccgcaaggcggagctaatcgccaaacgtggtctcagtgcagatcgggggctgcaactcgcccccgtgaaggcggagttgctagtaaccgcgtatcagccatggcgcggtgaatacgttcccgggccttgtacacaccgcccgtcacgtcatgggagtggctaatgcttgaagtccgtgtgctaacccgtcagggaggcagcggccgagggcaggagccgcgactgggacgaagtcgtaacaaggtagccgtaccggaaggtgcggctggatcacctcctttctaggga

SEQ ID NO: 2649 - DNA, 1493 bp, Chloroflexus sp. MS-G
  ref <308>: DATABASE ACCESSION NUMBER: NCBI ACCESSION: NZ_JPIM01000237.1
  ref <309>: DATABASE ENTRY DATE: 2019-04-01
  ref <313>: RELEVANT RESIDUES IN SEQ ID NO: (1)..(1493)
atgtagagtttgatcctggctcaggacgaacgctggcggcgtgcctaatgcatgcaagtcgaacgcagcagcttcggctggctgcgtggcgaacggctgaggaacacgtgggtgacctgccccagagtgggggataccccgtcgaaagacgggataatcccgcatacgctctacggaggaaagcccctacgggcgctctgggaggggcctgcggcccatcaggttgttggtgtggtaacggcgcaccaagccactgacgggtacccggtctgagaggacggccgggcagactgggactgcgacacggcccagactcctacgggaggcagcagcaaggaattttccccaatgggcggaagcctgagggagcaacgccgcgtggaggacgacggccttcgggttgtaaactcctttcgggtgggacgaccgcgacggtaccaccagaagcagccccggctaactctgtgccagcagccgcggtaagacagagggggcaagcgttgtccggagttactgggcgtaaagggcgcggaggcggtctgcggcgtcggcgctgaaagcgccccgcttaacggggcgaggcgtgccgatacgcgcagacttgaggcgagcagagggtggtggaattccgggtggagcggtgaaatgcgtagagatccggaggaacgccagtggggaagccggccacctgggctcggcctgacgctgcggcgcgaccgcgtggggagcaaaccggattagatacccgggtagtccacgccgtaaacgatgccagctcggcgtgtggcgcacggtcgtgcgctgcgtgccttagctcacgcgataagctggccgcctggggactacgagcgcaagcttaaaactcaaaggaattgacgggggcccgcacaagcagcggagcgtgtggtttaattcgacgcaacacgaagaaccttacctgggcttgacatgacgctgcacgccgtcgaaagacggccgcctgcgagggtgcgtcacaggtgctgcatggctgtcgtcagctcgtgtcgtgagatgttgggttcagtcccgcaacgagcgcaacccgcgtcggtagttacccgtgtctaccgagactgccgccgtgaccggcggaggaaggcgcggatgacgtcaagtcagcatggcccttacgtccagggcgacacacacgctacaatggccacgacaatgcgttgccaagccgcaaggcggagctaatcgcttaaacgtggtctcagtgcagatcgggggctgcaactcgcccccgtgaaggcggagttgctagtaaccgcgtatcagccatggcgcggtgaatacgttcccgggccttgtacacaccgcccgtcacgtcatgggagtggccaatgcttgaagtccgtgtgctaaccccccaacggggaggcagcggccgagggcaggggccgcgactgggacgaagtcgtaacaaggtagccgtaccggaaggtgcggctggatcacctcctttctaggga

SEQ ID NO: 2650 - DNA, 1492 bp, Chloroflexus sp. Y-396-1
  ref <308>: DATABASE ACCESSION NUMBER: NCBI ACCESSION: NZ_KI911784.1
  ref <309>: DATABASE ENTRY DATE: 2019-04-01
  ref <313>: RELEVANT RESIDUES IN SEQ ID NO: (1)..(1492)
atgtagagtttgatcctggctcaggacgaacgctggcggcgtgcctaatgcatgcaagtcgaacgcagcagctccggctggctgcgtggcgaacggctgaggaacacgtgggtgacctgccccggagtgggggataccccgtcgaaagacgggataatcccgcatacgctctacggaggaaagctcattcgggcgctccgggaggggcctgcggcccatcaggtagttggtgtggtaacggcgcaccaagccgctgacgggtacccggtctgagaggacgaccgggcagactgggactgcgacacggcccagactcctacgggaggcagcagcaaggaattttccccaatgggcgcaagcctgagggagcaacgccgcgtggaggacgacggccttcgggttgtaaactcctttcgggtgggacgacaccgacggtaccaccagaagcagccccggctaactctgtgccagcagccgcggtaagacagagggggcaagcgttgtccggagttactgggcgtaaagggcgcggaggcggcctgcggcgtcggcgctgaaagcgccccgcttaacggggcgaggcgtgccgatacgcgcaggctcgaggcgagcagagggtggtggaattccgggtggagcggtgaaatgcgtagagatccggaggaacgccagtggggaagccggccacctgggctcgtcctgacgctgcggcgcgacagcgtggggagcaaaccggattagatacccgggtagtccacgccgtaaacgatgccagctcggcgtgtggcgcacggtcgtgtgctgcgtgccttagctcacgcgataagctggccgcctggggactacgagcgcaagcttaaaactcaaaggaattgacgggggcccgcacaagcagcggagcgtgtggtttaattcgacgcaacacgaagaaccttacctgggcttgacatgacgctgcacgccgtcgaaagacggccgcctacgagggtgcgtcacaggtgctgcatggctgtcgtcagctcgtgtcgtgagatgttgggttcagtcccgcaacgagcgcaacccgcgtcggtagttacccgtgtctaccgagactgccgccgtgaccggcggaggaaggcgcggatgacgtcaagtcagcatggcccttacgtccagggcgacacacacgctacaatggccacgacaatgcgttgccaagccgcaaggcggagctaatcgcctaaacgtggtctcagtgcagatcgggggctgcaactcgcccccgtgaaggcggagttgctagtaaccgcgtatcagccatggcgcggtgaatacgttcccgggccttgtacacaccgcccgtcacgtcatgggagtggccaatgcttgaagtccgtgtgctaaccccccacggggaggcagcggccgagggcaggggccgcgactgggacgaagtcgtaacaaggtagccgtaccggaaggtgcggctggatcacctcctttctaggga

SEQ ID NO: 2651 - DNA, 929 bp, Chlorogloea sp. CCALA 695
  ref <308>: DATABASE ACCESSION NUMBER: NCBI ACCESSION: NZ_PVWN01000050.1
  ref <309>: DATABASE ENTRY DATE: 2019-04-01
  ref <313>: RELEVANT RESIDUES IN SEQ ID NO: (1)..(929)
aaaacggagagtttgatcctggctcaggatgaacgctggcggtatgcttaacacatgcaagtcgaacggatgttttcggacattagtggcggacgggtgagtaacgcgtgagaatctagcttcaggttggggacaacagttggaaacgactgctaataccgaatatgccgagaggtgaaagattaattgcctgaagaagagctcgcgtctgattagctagttggtggggtaagagcttaccaaggcgacgatcggtagctggtctgagaggacgatcagccacactgggactgagacacggcccagactcctacgggaggcagcagtggggaattttccgcaatgggcgaaagcctgacggagcaataccgcgtgagggaagaaggctcttgggttgtaaacctcttttcttagggaagaaaaaaatgacggtacctaaggaataagcatcggctaactccgtgccagcagccgcggtaatacggaggatgcaagcgttatccggaatgattgggcgtaaagcgtccgcaggtggtttatcaagtttgcggttaaaggttctggctcaaccagagacaggccgtgaaaactgatagactagagtatggtaggggcagagggaattcccagtgtagcggtgaaatgcgtagagattgggaagaacaccggtggcgaaagcgctctgctaggccaaaactgacactgagggacgaaagctaggggagcgaatgggattagataccccagtagtcctagccgtaaacgatggatactaggtgtagcttgtatcgacccaagctgtgccgtagctaacgcgttaagtatcccgcctggggagtacgcgcgcaagcgtgaaactcaaaggaattgacgggggcccgcacaagcggtggagtatgtggtttaattcgatgcaacgcgaagaacct

SEQ ID NO: 2652 - DNA, 1496 bp, Chlorogloeopsis fritschii
  ref <308>: DATABASE ACCESSION NUMBER: NCBI ACCESSION: NZ_RSCJ01000071.1
  ref <309>: DATABASE ENTRY DATE: 2019-04-01
  ref <313>: RELEVANT RESIDUES IN SEQ ID NO: (1)..(1496)
aaaacggagagtttgatcctggctcaggatgaacgctggcggtatgcttaacacatgcaagtcgaacggtctttttcggaagatagtggcggacgggtgagtaacgcgtgagaatctggctctaggttcgggacaaccactggaaacggtggctaataccggatgtgccgaagaggtgaaaggctagctgcctagagatgagctcgcgtctgattagctagatggtggggtaagagcctaccatggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaagagatgacggtacctgaggaagaagcatcggctaactccgtgccagcagccgcggtaatacggaggatgcaagcgttatccggaatgattgggcgtaaagcgtccgtaggtggtgatgcaagtctattgtcaaagcgtgcggctcaaccgcataaaggcagtggaaactgtgtaactagagtgcattcggggcagggggaattcctggtgtagcggtgaaatgcgtagagatcaggaagaacaccggtggcgaaagcgccctgctaggctgcaactgacactgagggacgaaagctaggggagcgaatgggattagataccccagtagtcctagctgtaaacgatggatactaggcgttgcgtgtatcgacccacgcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaaccgaagtgaaagcttcgggtgccttcgggagccggaacacaggtggtgcatggctgtcgtcagctcgtgtcgtgagatgttgggttaagtcccgcaacgagcgcaaccctcgttcttagttgccagcacttcgggtgggcactctaaggagactgccggtgacaaaccggaggaaggtggggatgacgtcaagtcagcatgccccttacgtcctgggctacacacgtactacaatgctcaagacagagggcagcaagctagcgatagcaagcaaatctcgtaaacttgggctcagttcagatcgcaggctgcaactcgcctgcgtgaaggaggaatcgctagtaatcgcaggtcagcatactgcggtgaattcgttcccgggccttgtacacaccgcccgtcacaccatggaagctggtcatgcccgaagtcgttaccctaactctttttgagagggggatgccgaaggcgggactggtgactggggtgaagtcgtaacaaggtagccgtaccggaaggtgtggctggatcacctccttttta

SEQ ID NO: 2653 - DNA, 1501 bp, Chloroherpeton thalassium
  ref <308>: DATABASE ACCESSION NUMBER: NCBI ACCESSION: NC_011026.1
  ref <309>: DATABASE ENTRY DATE: 2019-04-01
  ref <313>: RELEVANT RESIDUES IN SEQ ID NO: (1)..(1501)
ttacaacggagagtttgatcctggctcaggacgaacgctggcggcgtgcctaacacatgcaagccaaaggaaagcttcggttagtacttggcgtacgggtgagtaaggtataggtaatctgcctcttggtctgacataccttcgagaaatcgaagataatttcagataatgcagcggcaccgcatggtgatgttgttaaagacttgttgccaagagatgagcctatatttcatcaggtagttggtggggtaatagcctaccaagcctacgacggataactggtctgagaggatgatcagtcacactggaactgagacacggtccagactcctacgggaggcagcagtgaggaatattgcgcaatgggtgaaagcctgacgcagcaacgccgcgtggatgatgaagttcttaggaatgtaaagtccttttgtaagggaagaaaatctcgcttggtgagactgacggtaccttatgaataagccacggctaactctgtgccagcagccgcggtgatacaggggtggcaagcgttgtccggatttactgggtgtaaagggtgcgtaggcggattgattagtcgggagttaaagcctcttgcttaacgagagaacagcttccgatactgtcagtctagagtgccgaagaggaagatggaatttccggtgtagcggtggaatgtgtagagatcggaaagaacaccagttgcgaaggcagtcttctggtcggtaactgacgctgatgtacgaaagcgtgggtagcaaacaggattagataccctggtagtccacgctgtaaacgatggatgctagatgttggctcttgggtcagtgtcgtagttaacgcattaagcatcccacctgggaagtacgctcgcaagggtgaaactcaaaggaattgacgggggcccgcacaagcggtggatcatgtggtttaattcgatgcaacgcgaagaaccttacctgggcttgacatgctaactaaagccggtgaaagccggtgtccgaaagggagttagtgcaggtgctgcatggctgtcgtcagctcgtgtcgtgagatgttgggttaagtcccgcaacgagcgcaacccttacaattagttgctaacaagtaatgttgagcactctaattggactgcctacgcaagtagtgaggaaggaggggatgacgtcaagtcctcatggcccttacgtccagggcaacacacgtgatacaatggcgactacaatgggcgaagccgcgaggtgaagataatcccaaaaaagtcgtctcagtccagatcggagtctgcaactcgactccgtgaagtcggaatcgctagtaatcgcagatcagcatgctgcggtgaatacgttcccgggccttgtacacaccgcccgtcaagccatggaagtcaggagtacccaaagacgctgtgcgtttaaggtaagactggtaactggggctaagtcgtaacaaggtagccgtaccggaaggtgtggctggatcacctcctttctatgga

SEQ ID NO: 2654 - DNA, 1498 bp, Chondrocystis sp. NIES-4102
  ref <308>: DATABASE ACCESSION NUMBER: NCBI ACCESSION: NZ_AP018281.1
  ref <309>: DATABASE ENTRY DATE: 2019-04-01
  ref <313>: RELEVANT RESIDUES IN SEQ ID NO: (1)..(1498)
attcatcatggagagtttgatcctggctcaggatgaacgctggcggtatgcctaacacatgcaagtcgaacgatgttttcggacatagtggcggacgggtgagtaacgcgtgagaatctgccttcaggatggggataacagtgggaaatcgctgctaaaacccaatgagccgagaggtaaaatatttatagcctgaagaggagctcgcgtccgattagttagttggtgtggtaagagcataccaagacgatgatcggtagctggtctgagaggatgagcagccacactgggactgagacacggcccagactcctacgggaggcagcagtggggaattttccgcaatgggcgaaagcctgacggagcaataccgcgtgagggaggaaggcttttgggttgtaaacctcttttattaaggaagaagaaagtgacggtacttaaagaataagcatcggctaactccgtgccagcagccgcggtaatacggaggatgcaagcgttatccggaattattgggcgtaaagcgtccgcaggtggctaatcaagtctgctgttaaagacagaagcttaacttctgagaggcggtggaaactggatagctagagtacggtaggggttgagggaattcccagtgtagcggtgaaatgcgtagatattgggaagaacaccagtggcgaaggcgctcaactgggccgtaactgacactgagggacgaaagctaggggagcgaaagggattagatacccctgtagtcctagctgtaaacgatgaacactaggcgttgcttgtatcgacccgagcagtgccgtagccaacgcgttaagtgttccgcctggggagtacgcacgcaagtgtgaaactcaaaggaattgacgggggcccgcacaagcggtggagtatgtggtttaattcgatgcaacgcgaagaaccttaccaggacttgacatctcgagaagctctaggagactagagcgtgccttagggaactcgaagacaggtggtgcatggctgtcgtcagctcgtgtcgtgagatgttgggttaagtcccgcaacgagcgcaaccctcgttcttagttgccagcattaagttgggcactctaggaagactgccggtgacaaaccggaggaaggtggggatgacgtcaagtcagcatgccccatacgttctgggctacacacgtactacaatggttgggacaaagggcagcaagctcgcgagagtaagcgaatctcagcaaacccagcctcagttcagattgcaggctgcaactcgcctgcatgaaggaggaatcgctagtaatcgcaggtcagaatactgcggtgaattcgttcccgggccttgtacacaccgcccgtcacaccatggaagttggccacgcccgaagtcgttaccctaaccaatatggagggggatgccgaaggcagggctggtgactagggtgaagtcgtaacaaggtagccgtaccggaaggtgtggctggatcacctccttaaaggg

SEQ ID NO: 2655 - DNA, 1541 bp, Christensenella massiliensis
  ref <308>: DATABASE ACCESSION NUMBER: NCBI ACCESSION: NZ_LT700187.1
  ref <309>: DATABASE ENTRY DATE: 2019-04-01
  ref <313>: RELEVANT RESIDUES IN SEQ ID NO: (1)..(1541)
ttttaattaagagtttgatcctggctcaggacgaacgctggcggcgtgcttaacacatgcaagtcgaacgaagttatccagacagaagccttcgggtggaagattggatatacttagtggcggacgggtgagtaacgcgtgagcaacctgccctgcaaagggggacaacagttggaaacgactgctaataccgcatgagaccacgaaaccgcatggttttgaggtaaaaggatttattcgatgcaggatgggctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggggaaaccctgacccagcaacgccgcgtgagggaagaaggtcttcggattgtaaacctttgtcctatgggacgaagaaagtgacggtaccataggaggaagctccggctaactacgtgccagcagccgcggtaatacgtagggagcgagcgttgtccggaattactgggcgtaaagggtgcgtaggtggtcaagtaagtcagatgtgaaagaccggggcttaaccccgggattgcatttgaaactgtttgacttgagtacaggagagggaagtggaattcctagtgtagcggtgaaatgcgtagatattaggaggaacaccagtggcgaaggcgactttctggactgcaactgacactgaggcacgaaagcgtggggagcaaacaggattagataccctggtagtccacgccgtaaacgatggatactaggtgtggggcccgatagggttccgtgccgaagcaaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacggctgtagagatacagcttcccttcggggcagagagacaggtggtgcatggttgtcgtcagctcgtgtcgtgagatgttgggttaagtcccgcaacgagcgcaacccttattgctagttgccagcacgtcatggtgggaactctagtgagactgccggggacaactcggaggaaggtggggacgacgtcaaatcatcatgccccttatgtcttgggctacacacgtgctacaatggccggtacaaagggcagcgacgtcgtaaggcagagcgaatctcaaaaagccggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgcaaggagagagctgtcgaaggtgagatcaatgactggggtgaagtcgtaacaaggtagccgtatcggaaggtgcggctggatcacctcctttcta

SEQ ID NO: 2656 - DNA, 1536 bp, Christensenella minuta
  ref <308>: DATABASE ACCESSION NUMBER: NCBI ACCESSION: NZ_CP029256.1
  ref <309>: DATABASE ENTRY DATE: 2019-04-01
  ref <313>: RELEVANT RESIDUES IN SEQ ID NO: (1)..(1536)
aattaagagtttgatcctggctcaggacgaacgctggcggcgtgcttaacacatgcaagtcgaacgaggttgccctttgtgaatccttcgggaggaactgtgggtataccgagtggcggacgggtgagtaacgcgtgagcaacctgccctgcaacgggggacaacagttggaaacgactgctaataccgcatgagaccacgaaaccgcatggttttgaggtaaaaggatttattcgatgcaggatgggctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggggaaaccctgacccagcaacgccgcgtgagggaagaaggtcttcggattgtaaacctttgtcctatgggacgaaagaaatgacggtaccataggaggaagctccggctaactacgtgccagcagccgcggtaatacgtagggagcaagcgttgtccggaattactgggcgtaaagggtgcgtaggtggtcatgtaagtcagatgtgaaagaccggggcttaaccccggggttgcatttgaaactgtgtgacttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtggggcccgatagggttccgtgccgaagcaaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgactgtagagatacagtttcccttcggggcagagagacaggtggtgcatggttgtcgtcagctcgtgtcgtgagatgttgggttaagtcccgcaacgagcgcaacccttattgctagttgccagcgcgtaaaggcgggaactctagtgagactgccggggacaactcggaggaaggtggggacgacgtcaaatcatcatgccccttatgtcttgggctacacacgtgctacaatggccggtacaaagggcagcgaacccgtaaggggaagcgaatctcaaaaagccggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgtaaggagagagctgtcgaaggtgagatcaatgactggggtgaagtcgtaacaaggtagccgtatcggaaggtgcggctggatcacctcctttct

SEQ ID NO: 2657 - DNA, 1541 bp, Christensenella sp. AF73-05CM02
  ref <308>: DATABASE ACCESSION NUMBER: NCBI ACCESSION: NZ_MAIQ01000023.1
  ref <309>: DATABASE ENTRY DATE: 2019-04-01
  ref <313>: RELEVANT RESIDUES IN SEQ ID NO: (1)..(1541)
ttttaattaagagtttgatcctggctcaggacgaacgctggcggcgtgcttaacacatgcaagtcgaacgaagttgctctttgtgaagccctcgggtggaactgcgagtatacttagtggcggacgggtgagtaacgcgtgagcaatctgccctgcaatgggggacaacagttggaaacgactgctaataccgcatgagaccacgaaaccgcatggttttgaggtaaaaggatttattcgatgcaggatgagctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggggaaaccctgacccagcaacgccgcgtgagggaagaaggtcttcggattgtaaacctttgtcctatgggacgaaacaaatgacggtaccataggaggaagctccggctaactacgtgccagcagccgcggtaatacgtagggagcaagcgttgtccggaattactgggcgtaaagggtgcgtaggtggctatgtaagtcagatgtgaaagaccggggcttaaccccggggttgcatttgaaactgtgtggcttgagtacaggagagggaagtggaattcctagtgtagcggtgaaatgcgtagatattaggaggaacaccagtggcgaaggcgactttctggactgtaactgacactgaagcacgaaagcgtggggagcaaacaggattagataccctggtagtccacgccgtaaacgatggatactaggtgtggggcccgatagggttccgtgccgaagctaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgactgtagagatacagtttcccttcggggcagagagacaggtggtgcatggttgtcgtcagctcgtgtcgtgagatgttgggttaagtcccgcaacgagcgcaacccttattgctagttgccagcgcgtaaaggcgggaactctagtgagactgccggggacaactcggaggaaggtggggacgacgtcaaatcatcatgccccttatgtcttgggctacacacgtgctacaatggccggtacaaagggcagcgaacccgtaaggggaagcgaatctcaaaaagccggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgtaaggagagagctgtcgaaggtgagatcaatgactggggtgaagtcgtaacaaggtagccgtatcggaaggtgcggctggatcacctcctttcta

SEQ ID NO: 2658 - DNA, 1536 bp, Christensenella sp. Marseille-P3954
  ref <308>: DATABASE ACCESSION NUMBER: NCBI ACCESSION: NZ_LR026983.1
  ref <309>: DATABASE ENTRY DATE: 2019-04-01
  ref <313>: RELEVANT RESIDUES IN SEQ ID NO: (1)..(1536)
aaacagaagagtttgatcctggctcaggacgaacgctggcggcgcgcttaacacatgcaagtcgaacggggtacggaagtagcttgctacggaagatacctagtggcgaacgggtgagtaacgcgtgagcaaccggtccttaagagggggacaaccttgagaaatcaaggctaataccgcgtaagaccacggttagacatctaacaggggtcaaaggagaaatccgcttaagggagggctcgcgtcccattaggtagttggtagggtaacggcctaccaagccgacgatgggtagccgtgctgagaggcaggccggccacactggaactgagacacggtccagactcctacgggaggcagcagtggggaatcttgggcaatgggggaaaccctgacccagcgacgccgcgtgaaggaagaaggctttcgggttgtaaacttctgtgacaggggacgaaagaaatgacggtaccctgagaggaagccccggctaactacgtgccagcagccgcggtaatacgtagggggcgagcgttgtccggaattactgggcgtaaagggcgcgtaggcggcataataagtctgttgtgaaaatccagcgcttaacgttggacgtgcaatggaaactattaagctcgagtgtggtagaggcaagtggaattcccagtgtagcggtgaaatgcacagagattgggaggaacaccagtggcgaaggcgacttgctgggccaagactgacgctgaagcgcgaaagcgtggggagcaaacaggattagataccctggtagtccacgccgtaaacgatggatactaggtgtagggggtttcgacgccttctgtgccggagtgaacgcaataagtatcccgcctggggagtacggccgcaaggttgaaactcaaaggaattgacgggggcccgcacaagcagcggagcatgtggtttaattcgaagcaacgcgaagaaccttaccaggtcttgacatccatctaaagccatagagatatggtgtctcttcggaggagatgagacaggtggtgcatggttgtcgtcagctcgtgtcgtgagatgttgggttaagtcccgcaacgagcgcaacccttacggatagttgccagtgagtaaagtcaggcactctatcgggactgccgtggagaacacggaggaaggtggggacgacgtcaaatcatcatgccccttatgacctgggctacacacgtgctacaatggctgtgacaaagagaagcgagaccgtaaggtggagcggatctcaaaaaaacagtcccagttcggattgtgggctgcaacccgcccacatgaagtcggagttgctagtaatcgcgaatcagcatgtcgcggtgaatgcgttcccgggccttgtacacaccgcccgtcacaccatgggagttgggggcgcccgaagccagtgaggtaacccgcaagggagccagctgtcgaaggcgaaaccgatgactggggtgaagtcgtaacaaggtagccgtatcggaaggtgcggctggatcacctcctttctaggga

SEQ ID NO: 2659 - DNA, 1540 bp, Christensenella timonensis
  ref <308>: DATABASE ACCESSION NUMBER: NCBI ACCESSION: NZ_FLKP01000001.1
  ref <309>: DATABASE ENTRY DATE: 2019-04-01
  ref <313>: RELEVANT RESIDUES IN SEQ ID NO: (1)..(1540)
ttttaattaagagtttgatcctggctcaggacgaacgctggcggcgtgcttaacacatgcaagtcgaacgaggttgctctttgtgaatccttcgggaggaactgtgagtataccgagtggcggacgggtgagtaacgcgtgagcaacctgccctgcaacgggggacaacagttggaaacgactgctaataccgcatgagaccacggtttcgcatggaactggggtaaaaggatttattcgatgcaggatgggctcgcgtcccattagatagttggtgaggtaacggcccaccaagtcaacgatgggtagccgacctgagagggtgatcggccacactggaactgagacacggtccagactcctacgggaggcagcagtggggaatattgggcaatgggcgaaagcctgacccagcaacgccgcgtgagggaagaaggtcttcggattgtaaacctttgtcctatgggacgaaacaaatgacggtaccataggaggaagctccggctaactacgtgccagcagccgcggtaatacgtagggagcaagcgttgtccggaattactgggcgtaaagggtgcgtaggtggccatgtaagtcaggtgtgaaagaccggggctcaaccccggggcggcacttgaaactgtgtggcttgagtacaggagagggaagtggaattcctagtgtagcggtgaaatgcgtagatattaggaggaacaccagtggcgaaggcgactttctggactgtaactgacactgaggcacgaaagcgtggggagcaaacaggattagataccctggtagtccacgccgtaaacgatggatactaggtgtggggggcgatagtcctccgtgccgaagctaacgcattaagtatcccgcctggggagtacgatcgcaaggttgaaactcaaaggaattgacgggggcccgcacaagcagcggagcatgtggtttaattcgaagcaacgcgaagaaccttaccaaggcttgacatcctctgacgcatgtagagatacatgttcccttcggggcagagagacaggtggtgcatggttgtcgtcagctcgtgtcgtgagatgttgggttaagtcccgcaacgagcgcaacccttattgctagttgccagcgagtaaagtcgggaactctagtgagaccgccggggacaactcggaggaaggtggggacgacgtcaaatcatcatgccccttatgtcttgggctacacacgtgctacaatggccggtacaaagggcagcgaccccgtaagggtgagcgaatctcaaaaagccggtcccagttcggattgtgggctgcaacccgcccacatgaagtcggagttgctagtaatcgcgaatcagcatgtcgcggtgaatgcgttcccgggccttgtacacaccgcccgtcacaccacggaagttgggagcacccgaagccagtggcttaaccgtaaggagagagctgtcgaaggtgagatcaatgactggggtgaagtcgtaacaaggtagccgtatcggaaggtgcggctggatcacctcctttct

SEQ ID NO: 2660 - DNA, 1500 bp, Chromatiaceae bacterium 2141T.STBD.0c.01a
  ref <308>: DATABASE ACCESSION NUMBER: NCBI ACCESSION: NZ_CP019936.1
  ref <309>: DATABASE ENTRY DATE: 2019-04-01
  ref <313>: RELEVANT RESIDUES IN SEQ ID NO: (1)..(1500)
gaactgaagagtttgatcctggctcagattgaacgctggcggcatgcctaacacatgcaagtcgaacgcgaaatcaccttcgggtgagagtagagtggcggacgggtgagtaatgcttgggaatctgcccagtagtgggggataactcggggaaactcgagctaataccgcatacgccctacgggggaaagatttatcgctattggatgagcccaagtcagattagctagttggtggggtaaaggcctaccaaggcaacgatctgtagctggtctgagaggacgaacagccacactgggactgagacacggcccagactcctacgggaggcagcagtggggaatattggacaatgggcgaaagcctgatccagcaatgccgcgtgtgtgaagaaggcctgcgggttgtaaagcactttcagttgggaagatgatgacgttaccaacagaagaagcaccggctaactccgtgccagcagccgcggtaatacggagggtgcaagcgttaatcggaattactgggcgtaaagcgcgcgtaggcggctaagtcagtcagatgtgaaagccccgggcttaacctgggaattgcatttgatactgcttggctagagtgtggtagagggaagtggaattccaggtgtagcggtgaaatgcgtagatatctggaggaacaccagtggcgaaggcgacttcctggaccaacactgacgctgaggtgcgaaagcgtgggtagcaaacaggattagataccctggtagtccacgccgtaaacgatgtcaactagccgtcggattcatttaggaatttggtggcgcagctaacgcgataagttgaccgcctggggagtacggccgcaaggttaaaactcaaaggaattgacgggggcccgcacaagcggtggagcatgtggtttaattcgatgcaacgcgaagaaccttaccagcccttgacatcctcggaactttctagagatagattggtgccttcgggaaccgagtgacaggtgctgcatggctgtcgtcagctcgtgtcgtgagatgttgggttaagtcccgtaacgagcgcaacccttgtccttagttgccagcatttcggatgggaactctaaggagactgccggtgacaaaccggaggaaggtggggatgacgtcaagtcatcatggcccttatgggctgggctacacacgtgctacaatggtcagtacagagggtcgcgaacccgcgaggggaagctaatctcacaaaactgatcgtagtccggatcgcagtctgcaactcgactgcgtgaagtcggaatcgctagtaatcgcagatcagaatgctgcggtgaatacgttcccgggccttgtacacaccgcccgtcacaccatgggagtgggttgcaaaagaagtggctagtctaaccttcgggaggacggtcaccactttgtgattcatgactggggtgaagtcgtaacaaggtagccgtaggggaacctgcggctggatcacctcctttaaa

SEQ ID NO: 2661 - DNA, 1336 bp, Chromatocurvus halotolerans
  ref <308>: DATABASE ACCESSION NUMBER: NCBI ACCESSION: NZ_QQSW01000041.1
  ref <309>: DATABASE ENTRY DATE: 2019-04-01
  ref <313>: RELEVANT RESIDUES IN SEQ ID NO: (1)..(1336)
ggacctcgtgctatcggatgagcctgcgttggattagctagttggtggggtaaaggcctaccaaggcaacgatccatagctggtctgagaggatgatcagccacaccgggactgagacacggcccggactcctacgggaggcagcagtggggaatattgcgcaatgggcgaaagcctgacgcagccatgccgcgtgtgtgaagaaggccttcgggttgtaaagcactttcacttgggaagaaagggtgcgtgttaatagcacgtatctgtgacattaccttgagaagaagcaccggctaactccgtgccagcagccgcggtaatacggagggtgcaagcgttaatcggaattactgggcgtaaagcgcgcgtaggcggtttgttaagttggatgtgaaatccccgggctcaacctgggaatggcacccgatactggccgactagagtacgagagagggaggtagaattccacgtgtagcggtgaaatgcgtagatatgtggaggaataccggtggcgaaggcggcctcctggctcgatactgacgctgaggtgcgaaagcgtggggagcaaacaggattagataccctggtagtccacgccgtaaacgatgtctactagccgttggggaacttgattctttggtggcgcagttaacgcgataagtagaccgcctggggagtacggccgcaaggttaaaactcaaatgaattgacgggggcccgcacaagcggtggagcatgtggtttaattcgatgcaacgcgaagaaccttaccaggtcttgacatccagagaactttccagagatggattggtgccttcgggagctctgagacaggtgctgcatggctgtcgtcagctcgtgtcgtgagatgttgggttaagtcccgtaacgagcgcaacccttgtccttagttgccagcgcgtaatggcgggaactctaaggagactgccggtgacaaaccggaggaaggtggggacgacgtcaagtcatcatggcccttacgacctgggctacacacgtgctacaatggaacgcacagagggcagcaagagcgcgagctggagcgaatcccacaaaacgtttcgtagtccggatcggagtctgcaactcgactccgtgaagtcggaatcgctagtaatcgcgaatcagaatgtcgcggtgaatacgttcccgggccttgtacacaccgcccgtcacaccatgggagtgggttgctccagaagtggttagcctaaccttcgggagggcgatcaccacggagtgattcatgactggggtgaagtcgtaacaaggtagccctaggggaacctggggctggatcacctccttaaac

SEQ ID NO: 2662 - DNA, 1543 bp, Chromobacterium rhizoryzae
  ref <308>: DATABASE ACCESSION NUMBER: NCBI ACCESSION: NZ_CP031968.1
  ref <309>: DATABASE ENTRY DATE: 2019-04-01
  ref <313>: RELEVANT RESIDUES IN SEQ ID NO: (1)..(1543)
attgaactgaagagtttgatcctggctcagattgaacgctggcggcatgctttacacatgcaagtcgaacggtaacagggtgcttgcaccgctgacgagtggcgaacgggtgagtaatgcatcggaatgtaccgtgtaatgggggatagctcggcgaaagccggattaataccgcatacgccctgagggggaaagtgggggaccgtaaggcctcacgttatacgagcagccgatgtctgattagctagttggtggggtaaaggctcaccaaggcaacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtccgggagcaaatcccagtggttaatacctactggggctgagagtaccggaagaataagcaccggctaactacgtgccagcagccgcggtaatacgtagggtgcaagcgttaatcggaattactgggcgtaaagcgtgcgcaggcggttgtgcaagtctgatgtgaaagccccgggcttaacctgggaacggcattggagactgcacgactagagtgcgtcagaggggggtagaattccgcgtgtagcagtgaaatgcgtagagatgcggaggaataccgatggcgaaggcagccccctgggatgacactgacgctcatgcacgaaagcgtggggagcaaacaggattagataccctggtagtccacgccctaaacgatgtcaactagctgttgggggtttgaatccttggtagcgaagctaacgcgagaagttgaccgcctggggagtacggccgcaaggttaaaactcaaaggaattgacggggacccgcacaagcggtggatgatgtggattaattcgatgcaacgcgaaaaaccttacctggtcttgacatgtaacgaacgccgcagagatgtggtggtgcccgaaagggagcgttaacacaggtgctgcatggctgtcgtcagctcgtgtcgtgagatgttgggttaagtcccgcaacgagcgcaacccttgccattagttgccatcattaagttgggcactctaatgggactgccggtgacaaaccggaggaaggtggggatgacgtcaagtcctcatggcccttatgaccagggcttcacacgtcatacaatggtcggtacagagggtcgcgaagccgcgaggtggagccaatctcataaaaccgatcgtagtccggatcgcactctgcaactcgagtgcgtgaagtcggaatcgctagtaatcgcagatcagcatgctgcggtgaatacgttcccgggtcttgtacacaccgcccgtcacaccatgggagtgagtttcaccagaagtgggtaggctaaccgtaaggaggccgcttaccacggtgggattcatgactggggtgaagtcgtaacaaggtagccgtaggggaacctgcggctggatcacctcctttctag

SEQ ID NO: 2663 - DNA, 1553 bp, Chromobacterium violaceum
  ref <308>: DATABASE ACCESSION NUMBER: NCBI ACCESSION: NZ_UIGR01000001.1
  ref <309>: DATABASE ENTRY DATE: 2019-04-01
  ref <313>: RELEVANT RESIDUES IN SEQ ID NO: (1)..(1553)
agattgaactgaagagtttgatcctggctcagattgaacgctggcggcatgctttacacatgcaagtcgaacggtaacagggtgcttgcaccgctgacgagtggcgaacgggtgagtaatgcgtcggaatgtaccgtgtaatgggggatagctcggcgaaagccggattaataccgcatacgccctgagggggaaagcgggggatcgaaagactcgcgttatacgagcagccgacgtctgattagctgagttggtgaggtaagagctcaccaaggcgacgatcagtagcgggtctgagaggatgatccgccacactgggactgagacacggcccagactcctacgggaggcagcagtggggaattttggacaatgggggcaaccctgatccagccatgccgcgtgtctgaagaaggccttcgggttgtaaaggacttttgtcagggaggaaatcccgctggttaatacccggcggggatgacagtacctgaagaataagcaccggctaactacgtgccagcagccgcggtaatacgtagggtgcgagcgttaatcggaattactgggcgtaaagcgtgcgcaggcggttgtgcacagtctgatgtgaaagccccgggcttaacctgggaacggcattggagactgcacagctagagtgcgtcagaggggggtagaattccacgtgtagcagtgaaatgcgtagagatgtggaggaataccgatggcgaaggcagccccctgggatgacactgacgctcatgcacgaaagcgtggggagcaaacaggattagataccctggtagtccacgccctaaacgatgtcaactagctgttgggggtttgaatccttggtagcgtagctaacgcgtgaagttgaccgcctggggagtacggccgcaaggttaaaactcaaaaggaattgacgggggacccgcacaagcggtggatgatgtggattaattcgatgcaacgcgaaaaaccttacctgctcttgacatgtacggaacttgccagagatggcttggtgcccgaaagggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaaaccggaggaaggtggggatgacgtcaagtcctcatggcccttatgagcagggcttcacacgtcatacaatggtcggtacagagggttgccaagccgcgaggtggagctaatctcagaaaaaccgatcgtagtccggatcgcactctgcaactcgagtgcgtgaagtcggaatcgctagtaatcgcagatcagcatgctgcggtgaatacgttcccgggtcttgtacacaccgcccgtccacaccatgggagtgagttttcaccagaagtgggtaggctaaccgtaaggaggccgcttacccacggtgggattcatgactggggtgaagtcgtaacaaggtagccgtagggggaacctgcggctggatcacctcctttctag

SEQ ID NO: 2664 - DNA, 1541 bp, Chromohalobacter salexigens
  ref <308>: DATABASE ACCESSION NUMBER: NCBI ACCESSION: NZ_MZZK01000003.1
  ref <309>: DATABASE ENTRY DATE: 2019-04-01
  ref <313>: RELEVANT RESIDUES IN SEQ ID NO: (1)..(1541)
caactgaagagtttgatcatggctcagattgaacgctggcggcaggcctaacacatgcaagtcgagcggtaacaggtccagcttgctggacgctgacgagcggcggacgggtgagtaatgcataggaatctacccagtcgtgggggataacctggggaaacccaggctaataccgcatacgtcctacgggagaaagcgggggctcttcggacctcgcgcgattggatgagcctatgtcggattagctggttggtggggtaacggctcaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctttcgggttgtaaagcactttcagtggggaagaaggcttgtcggccaatacccggcaagagcgacatcacccacagaagaagcaccggctaactccgtgccagcagccgcggtaatacggagggtgcaagcgttaatcggaattactgggcgtaaagcgcgcgtaggcggcttgtcacgccgggtgtgaaagccccgggctcaacctgggaacggcatccggaacgggcaggctagagtgcaggagaggaaggtagaattcccggtgtagcggtgaaatgcgtagagatcgggaggaataccagtggcgaaggcggccttctggactgacactgacgctgaggtgcgaaagcgtgggtagcaaacaggattagataccctggtagtccacgccgtaaacgatgtcgactagccgttgggtcccttgaggacttagtggcgcagttaacgcgataagtcgaccgcctggggagtacggccgcaaggttaaaactcaaatgaattgacgggggcccgcacaagcggtggagcatgtggtttaattcgatgcaacgcgaagaaccttacctacccttgacatcctgcgaacccggaagagattccggggtgccttcgggagcgcagagacaggtgctgcatggctgtcgtcagctcgtgttgtgaaatgttgggttaagtcccgtaacgagcgcaacccttgtccctatttgccagcgattcggtcgggaactctagggagactgccggtgacaaaccggaggaaggtggggacgacgtcaagtcatcatggcccttacgggtagggctacacacgtgctacaatggccggtacaaagggttgcgaagccgcgaggtgaagccaatcccagaaagccggcctcagtccggattggagtctgcaactcgactccatgaagtcggaatcgctagtaatcgtgcatcagaatggcacggtgaatacgttcccgggccttgtacacaccgcccgtcacaccatgggagtggactgcaccagaagtggttagcctaacttcggagggcgatcaccacggtgtggttcatgactggggtgaagtcgtaacaaggtagccgtaggggaacctgcggctggatcacctccttaaac

SEQ ID NO: 2665 - DNA, 1494 bp, Chroococcales cyanobacterium IPPAS B-1203
  ref <308>: DATABASE ACCESSION NUMBER: NCBI ACCESSION: NZ_PEIG01000029.1
  ref <309>: DATABASE ENTRY DATE: 2019-04-01
  ref <313>: RELEVANT RESIDUES IN SEQ ID NO: (1)..(1494)
aaaacggagagtttgatcctggctcaggatgaacgctggcggtatgcttaacacatgcaagtcgaacgaagtcttaggacttagtggcggacgggtgagtaacgcgtgagaatctggctttaggacggggataaccactggaaacggtggctaagacccgatatgccgagaggtgaaagtatttttagcctagaggggagctcgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgggggaggaaggctcttgggttgtaaactccttttctcagggaagaacacaatgacggtacctgaggaatcagcatcggctaactccgtgccagcagccgcggtaatacggaggatgcaagcgttatccggaatcattgggcgtaaagcgtccgcaggtggcatttcaagtctgctgtcaaaggtcggggcttaactccgaacaggcagtggaaactgagaagctagagtgcggtaggggcagagggaattcctggtgtagcggtgaaatgcgtagagatcaggaagaacaccggtggcgaaagcgctctgctaggccgcaactgacactcagggacgaaagctaggggagcgaatgggattagataccccagtagtcctagctgtaaacgatggatactaggcgttgcttgtatcgacccaagcagtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgcccggaatcttggggaaactcaagagtgcctacgggaaccgggacacaggtggtgcatggctgtcgtcagctcgtgtcgtgagatgttgggttaagtcccgcaacgagcgcaaccctcgtttttagttgccagcattaagttgggcactctagaaagactgccggtgacaaaccggaggaaggtggggatgacgtcaagtcagcatgccccttacgctctgggctacacacgtactacaatgctatggacaaagggcagcaagaatgcgaattcaagcaaatcccataaaccatggctcagttcagatcgcaggctgcaactcgcctgcgtgaaggcggaatcgctagtaatcgccggtcagccatacggcggtgaatacgttcccgggccttgtacacaccgcccgtcacaccatggaagctggccacgcccgaagtcgttaccctaaccgcttgcggagggggatgccgaaggcagggctggtgactggggtgaagtcgtaacaaggtagccgtaccggaaggtgtggctggatcacctccttttta

SEQ ID NO: 2666 - DNA, 1492 bp, Chroococcidiopsis cubana
  ref <308>: DATABASE ACCESSION NUMBER: NCBI ACCESSION: NZ_RSCK01000191.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtatgcttaacacatgcaagtcgaacggagcttttcggagcttagtggcggacgggtgagtaacgcgtgagaatctgccttttggaccgggacaactgctggaaacggcagctaagaccggatgtgcccttgggtgaaatattcatagccaaaagaggagctcgcgaccgattagctagttggtggggtaagagcctaccaaggctgcgatcggtagccggtttgagaggacgaccggccacactgggactgagacacggcccagactcctacgggaggcagcagtggggaattttccgcaatgggcgaaagcctgacggagcaataccgcgtgagggaggaaggctcttgggtcgtaaacctcttttctcagggaagaagcaatgacggtacctgaggaatcagcatcggctaactccgtgccagcagccgcggtaatacggaggatgcaagcgttatccggaatgattgggcgtaaagcgtccgcaggtggcacatcaagtctgctgtcaaagcccccagcttaactgggaagaggcggtggaaactggtgagctagagagcaataggggtagagggaattcccggtgtagcggtgaaatgcgtagagatcgggaagaacaccagtggcgaaagcgctctactaggttgcaactgacactgagggacgaaagctaggggagcgaatgggattagataccccagtagtcctagccgtaaacgatggatactaggcgtttctcgtatcgacccgaggagtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaacccgtgggaaactatggggtgccgaaaggagccagaacacaggtggtgcatggctgtcgtcagctcgtgtcgtgagatgttgggttaagtcccgcaacgagcgcaaccctcgtgtttagttgccatcattcagttgggcactctagacagactgccggtgacaaaccggaggaaggtggggatgacgtcaagtcagcatgccccttacgtcctgggcgacacacgtactacaatgctacggacaacgggaagccaaccagcgatggggagcaaagcccagcaaaccgtagctcagttcagatcgcaggctgcaactcgcctgcgtgaaggcggaatcgctagtaatcgccggtcagccatacggcggtgaatacgttcccgggccttgtacacaccgcccgtcacaccatggaagttggccacgcccgaagtcattactctaaccattcgtggaggaggaggccgaaggcagggctgatgactggggtgaagtcgtaacaaggtagccgtaccggaaggtgtggctggatcacctccttt

SEQ ID NO: 2667 - DNA, 1490 bp, Chroococcidiopsis sp. TS-821
  ref <308>: DATABASE ACCESSION NUMBER: NCBI ACCESSION: NZ_MVDI01000019.1
  ref <309>: DATABASE ENTRY DATE: 2019-04-01
  ref <313>: RELEVANT RESIDUES IN SEQ ID NO: (1)..(1490)
aaacggagagtttgatcctggctcaggatgaacgctggcggtatgcttaacacatgcaagtcgaacgaagtcttcggacttagtggcggacgggtgagtaacgcgtgagaatctggcttgaggacggggataaccactggaaacggtggctaagacccgatatgccgcgaggtgaaagtagatatagccttgaggggagctcgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgggggaggaaggctcttgggttgtaaactccttttctcagggaagaaggtctgacggtacctgaggaatcagcatcggctaactccgtgccagcagccgcggtaatacggaggatgcaagcgttatccggaatcattgggcgtaaagcgtccgtaggtggcatttcaagtctgctgtcaaaggtcggggcttaactccgaacaggcagtggaaactgagaagctagagtatggtaggggcagagggaattcctggtgtagcggtgaaatgcgtagagatcaggaagaacaccggtggcgaaagcgctctgctaggccataactgacactcagggacgaaagctaggggagcgaatgggattagataccccagtagtcctagctgtaaacgatggatactaggcgttgcttgtatcgacccaagcagtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaaccctgctgaaaggcgggggtgccttcgggagccggaacacaggtggtgcatggctgtcgtcagctcgtgtcgtgagatgttgggttaagtcccgcaacgagcgcaaccctcgtttttagttgccagcattaagttgggcactctagaaagactgccggtgacaaaccggaggaaggtggggatgacgtcaagtcagcatgccccttacgctctgggctacacacgtactacaatgctgtggacaaagggcagcaagaatgcgaattcaagcaaatcccagaaaccacggctcagttcagatcgcaggctgcaactcgcctgcgtgaaggcggaatcgctagtaatcgccggtcagccatacggcggtgaatacgttcccgggccttgtacacaccgcccgtcacaccatggaagctggccacgcccgaagtcgttaccctaacctttcgaggagggggacgccgaaggcagggctggtgactggggtgaagtcgtaacaaggtagccgtaccggaaggtgtggctggatcacctcctttt

SEQ ID NO: 2668 - DNA, 1492 bp, Chroococcidiopsis thermalis
  ref <308>: DATABASE ACCESSION NUMBER: NCBI ACCESSION: NC_019695.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtatgcttaacacatgcaagtcgaacggagcttttcggagcttagtggcggacgggtgagtaacgcgtgagaatctgccttttggaccgggacaactgctggaaacggcagctaagaccggatgtgcccttgggtgaaatattcatagccaaaagaggagctcgcgaccgattagctagttggtggggtaagagcctaccaaggctgcgatcggtagccggtttgagaggacgaccggccacactgggactgagacacggcccagactcctacgggaggcagcagtggggaattttccgcaatgggcgaaagcctgacggagcaataccgcgtgagggaggaaggctcttgggtcgtaaacctcttttctcagggaagaagcaatgacggtacctgaggaatcagcatcggctaactccgtgccagcagccgcggtaatacggaggatgcaagcgttatccggaatgattgggcgtaaagcgtccgcaggtggcacatcaagtctgctgtcaaagcccccagcttaactgggaagaggcggtggaaactggtgagctagagagcaataggggtagagggaattcccggtgtagcggtgaaatgcgtagagatcgggaagaacaccagtggcgaaagcgctctactaggttgcaactgacactgagggacgaaagctaggggagcgaatgggattagataccccagtagtcctagccgtaaacgatggatactaggcgtttctcgtatcgacccgaggagtgccggagccaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtctggaacccgtgggaaactatggggtgccgaaaggagccagaacacaggtggtgcatggctgtcgtcagctcgtgtcgtgagatgttgggttaagtcccgcaacgagcgcaaccctcgtgtttagttgccatcattcagttgggcactctagacagactgccggtgacaaaccggaggaaggtggggatgacgtcaagtcagcatgccccttacgtcctgggcgacacacgtactacaatgctacggacaacgggaagccaaccagcgatggggagcaaagcccagcaaaccgtagctcagttcagatcgcaggctgcaactcgcctgcgtgaaggcggaatcgctagtaatcgccggtcagccatacggcggtgaatacgttcccgggccttgtacacaccgcccgtcacaccatggaagttggccacgcccgaagtcattactctaaccattcgtggaggaggatgccgaaggcagggctgatgactggggtgaagtcgtaacaaggtagccgtaccggaaggtgtggctggatcacctccttt

SEQ ID NO: 2669 - DNA, 1498 bp, Chroogloeocystis siderophila
  ref <308>: DATABASE ACCESSION NUMBER: NCBI ACCESSION: NZ_MRCC01000040.1
  ref <309>: DATABASE ENTRY DATE: 2019-04-01
  ref <313>: RELEVANT RESIDUES IN SEQ ID NO: (1)..(1498)
aaaacggagagtttgatcctggctcaggatgaacgctggcggtatgcttaacacatgcaagtcgaacggtgtcttcggacatagtggcggacgggtgagtaacgcgtgagaatctggcttaaggacggggacaaccactggaaacggtggctaagacccgatatgccgagaggtgaaagtatttatagccttaaggggagctcgcgtctgattagctagttggtagggtaagagcttaccaaggcgacgatcagtagctggtctgagaggatgatcagccacactgggactgagacacggcccagactcctacgggaggcagcagtggggaattttccgcaatgggcgaaagcctgacggagcaataccgcgtgggggaggaaggctcttgggttgtaaactccttttctcagggaagaaaaaaatgacggtacctgaggaatcagcatcggctaactccgtgccagcagccgcggtaatacggaggatgcaagcgttatccggaatcattgggcgtaaagcgtccgcaggtggcacttcaagtctgctgtcaaaggtcggggcttaactccgaacaggcagtggaaactgaagcgctcgagtgcggtaggggcagagggaattcctggtgtagcggtgaaatgcgtagagatcaggaagaacaccggtggcgaaagcgctctgctaggccgcaactgacactcagggacgaaagctaggggagcgaatgggattagataccccagtagtcctagctgtaaacgatggatactaggcgttgcttgtatcgacccaagcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggtttgacatgtccggaaccccgctgaaaggtgggggtgccttagggaaccggaacacaggtggtgcatggctgtcgtcagctcgtgtcgtgagatgttgggttaagtcccgcaacgagcgcaaccctcgtttttagttgccagcattaagttgggcactctagaaagactgccggtgacaaaccggaggaaggtggggatgacgtcaagtcagcatgccccttacgctctgggctacacacgtactacaatgctatggacaaagggcagcaagttagcgatgacaagcaaatcccataaaccatggctcagttcagatcgcaggctgcaactcgcctgcgtgaaggcggaatcgctagtaatcgccggtcagccatacggcggtgaatacgttcccgggccttgtacacaccgcccgtcacaccatggaagctggccacgcccgaagtcgttaccctaaccgcttgcggagggggacgccgaaggcagggctggtgactggggtgaagtcgtaacaaggtagccgtaccggaaggtgtggctggatcacctcctttttaggga

SEQ ID NO: 2670 - DNA, 1521 bp, Chryseobacterium angstadtii
  ref <308>: DATABASE ACCESSION NUMBER: NCBI ACCESSION: NZ_LFND01000007.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtaggtttccttcgggagactgagagcggcgcacgggtgcggaacacgtgtgcaacctgcctttatcagggggatagcctttcgaaaggaagattaataccccataatatgttgaatggcatcattcgatattgaaaactacggtggataaagatgggcacgcgcaggattagatagttggtagggtaacggcctaccaagtcaacgatccttagggggcctgagagggtgatcccccacactggtactgagacacggaccagactcctacgggaggcagcagtgaggaatattggacaatgggtgaaagcctgatccagccatcccgcgtgaaggacgactgccctatgggttgtaaacttcttttgtatagggataaacctttccacgtgtggaaagctgaaggtactatacgaataagcaccggctaactccgtgccagcagccgcggtaatacggagggtgcaagcgttatccggatttattgggtttaaagggtccgtaggctgatttgtaagtcagtggtgaaatctcacagcttaactgtgaaactgccattgatactgcaagtcttgagtaaggtagaagtagctggaataagtagtgtagcggtgaaatgcatagatattacttagaacaccaattgcgaaggcaggttactatgtcttaactgacgctgatggacgaaagcgtggggagcgaacaggattagataccctggtagtccacgccgtaaacgatgctaactcgtttttgggttttcggattcagagactaagcgaaagtgataagttagccacctggggagtacggacgcaagtctgaaactcaaaggaattgacgggggcccgcacaagcggtggattatgtggtttaattcgatgatacgcgaggaaccttaccaaggcttaaatgggaattgacaggtttagaaatagacttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccggtacagagggcagctacacagcgatgtgatgcgaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2671 - DNA, 1522 bp, Chryseobacterium balustinum
  ref <308>: DATABASE ACCESSION NUMBER: NCBI ACCESSION: NZ_UAVR01000008.1
  ref <309>: DATABASE ENTRY DATE: 2019-04-01
  ref <313>: RELEVANT RESIDUES IN SEQ ID NO: (1)..(1522)
tacaatggagagtttgatcctggctcaggatgaacgctagcgggaggcctaacacatgcaagccgagcggtatagattcttcggaatctagagagcggcgtacgggtgcggaacacgtgtgcaacctacctttatcagggggatagcctttcgaaaggaagattaataccccataatatattgactggcatcagtcgatattgaaaactccggtggatagagatgggcacgcgcaagattagatagttggtagggtaacggcctaccaagtcagtgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcatagcttaactatgaaactgccattgatactgcaggtcttgagtaaagtagaagtggctggaataagtagtgtagcggtgaaatgcatagatattacttagaacaccaattgcgaaggcaggtcactatgttttaactgacgctgatggacgaaagcgtggggagcgaacaggattagataccctggtagtccacgccgtaaacgatgctaactcgtttttgggctttagggttcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgacaggtttagaaatagacttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccagtacagagggcagctaccaggcgactggatgcgaatctcgaaagctggtctcagttcggattggagtctgcaactcgactctatgaagctggaatcgctagtaatcgcatatcagccatgatgcggtgaatacgttcccgggccttgtacacaccgcccgtcaagccatggaagtttggggtacctgaagtcggtgaccgtaacaggagctgcctagggtaaaacaagtaactagggctaagtcgtaacaaggtagccgtaccggaaggtgcggctggaacatctcattttaga

SEQ ID NO: 2672 - DNA, 1522 bp, Chryseobacterium camelliae
  ref <308>: DATABASE ACCESSION NUMBER: NCBI ACCESSION: NZ_CP022986.1
  ref <309>: DATABASE ENTRY DATE: 2019-04-01
  ref <313>: RELEVANT RESIDUES IN SEQ ID NO: (1)..(1522)
tacaatggagagtttgatcctggctcaggatgaacgctagcgggaggcctaacacatgcaagctgagcggtagagatctttcgggatcttgagagcggcgtacgggtgcggaacacgtgtgcaacctgcctttatcagggggatagcctttcgaaaggaagattaatactccataatatattaaatggcatcatttgatattgaaaactccggtggatagagatgggcacgcgcaagattagatagttggtgaggtaacggctcaccaagtcgatgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtacagggataaacctatttacgtgtaaatagctgaaggtactgtacgaataagcaccggctaactccgtgccagcagccgcggtaatacggagggtgcaagcgttatccggatttattgggtttaaagggtccgtaggcggatgtgtaagtcagtggtgaaatctcacagcttaactgtgaaactgccattgatactgcatgtcttgagtaaggtagaagtggctggaataagtagtgtagcggtgaaatgcatagatattacttagaacaccaattgcgaaggcaggtcactatgtcttaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgatcggtttagaaatagaccttccttcgggcaattttcaaggtgctgcatggttgtcgtcagctcgtgccgtgaggtgttaggttaagtcctgcaacgagcgcaacccctgttactagttgctaccattaagttgaggactctagtaagactgcctacgcaagtagagaggaaggtggggatgacgtcaaatcatcacggcccttacgccttgggccacacacgtaatacaatggcaggtacagagggcagctacacagcgatgtgatgcgaatctcgaaagcctgtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaaaaggagctgcctagggtaaaacaggtaactagggctaagtcgtaacaaggtagccgtaccggaaggtgcggctggaacatctcattttaga

SEQ ID NO: 2673 - DNA, 1521 bp, Chryseobacterium flavum
  ref <308>: DATABASE ACCESSION NUMBER: NCBI ACCESSION: NZ_QNUE01000034.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagatctttcgggatcttgagagcggcgtacgggtgcggaacacgtgtgcaacctgcctttatctgggggatagcctttcgaaaggaagattaataccccataatatattgaatggcatcatttgatattgaaaactccggtggatagagatgggcacgcgcaagattagatagttggtgaggtaacggctcaccaagtcagcgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctaccctcgtgagggtagctgaaggtactatacgaataagcaccggctaactccgtgccagcagccgcggtaatacggagggtgcaagcgttatccggatttattgggtttaaagggtccgtaggctgatttgtaagtcagtggtgaaatctcacagcttaactgtgaaactgccattgatactgcaagtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggcttttgggttcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggcttagaaataggcttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacactgcgaagtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2674 - DNA, 1521 bp, Chryseobacterium kwangjuense
  ref <308>: DATABASE ACCESSION NUMBER: NCBI ACCESSION: NZ_LPUR01000005.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagtctcttcggagacttgagagcggcgtacgggtgcggaacacgtgtgcaacctgcctttatcagggggatagcctttcgaaaggaagattaataccccataatattctggatggcatcatttagaattgaaaactacggtggatagagatgggcacgcgcaagattagatagttggtagggtaacggcctaccaagtctacgatctttagggggcctgagagggtgatcccccacactggtactgagacacggaccagactcctacgggaggcagcagtgaggaatattggacaatgggtgaaagcctgatccagccatcccgcgtgaaggatgacggccctatgggttgtaaacttcttttgtatagggataaacctagatacgtgtatctagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtatatttgaagtagctggaataagtagtgtagcggtgaaatgcatagatattacttagaacaccaattgcgaaggcaggttactaaactataactgacgctgatggacgaaagcgtggggagcgaacaggattagataccctggtagtccacgccgtaaacgatgctaactcgtttttgggttttgggactcagagactaagcgaaagtgataagttagccacctggggagtacggacgcaagtctgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccggtacagagggcagctaccaggtgactggatgcgaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2675 - DNA, 1521 bp, Chryseobacterium lathyri
  ref <308>: DATABASE ACCESSION NUMBER: NCBI ACCESSION: NZ_QNFY01000033.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcggaatcttgagagcggcgcacgggtgcggaacacgtgtgcaacctgcctttgtcaggggaatagcctttcgaaaggaagattaatgccccataatatattaaatggcatcatttgatattgaaaactccggtggataaagatgggcacgcgcaggattagatagttggtagggtaacggcctaccaagtcaacgatccttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtacagggataaacctttccacgtgtgggaagctgaaggtactgtacgaataagcaccggctaactccgtgccagcagccgcggtaatacggagggtgcaagcgttatccggatttattgggtttaaagggtccgtaggcggactcgtaagtcagtggtgaaatctcacagcttaactgtgaaactgccattgatactgcgggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttggtttttcggaatcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgattggtttagaaatagaccgtccttcgggcaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2676 - DNA, 1521 bp, Chryseobacterium luteum
  ref <308>: DATABASE ACCESSION NUMBER: NCBI ACCESSION: NZ_JPRO01000001.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtaggtttccttcgggagactgagagcggcgcacgggtgcggaacacgtgtgcaacctgcctttatcagggggatagcctttcgaaaggaagattaataccccataatatatttgatggcatcattagatattgaaaactacggtggatagagatgggcacgcgcaggattagatagttggtagggtaacggcctaccaagtcaacgatccttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggctaactccgtgccagcagccgcggtaatacggagggtgcaagcgttatccggatttattgggtttaaagggtccgtaggctgatctgtaagtcagtggtgaaatctcacagctcaactgtgaaactgccattgatactgcaagtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggtcttcggattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgacaggcttagaaataggcttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccagtacagagggcagctacacagcgatgtgatgcaaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2677 - DNA, 1522 bp, Chryseobacterium oleae
  ref <308>: DATABASE ACCESSION NUMBER: NCBI ACCESSION: NZ_FOVD01000013.1
  ref <309>: DATABASE ENTRY DATE: 2019-04-01
  ref <313>: RELEVANT RESIDUES IN SEQ ID NO: (1)..(1522)
tacaatggagagtttgatcctggctcaggatgaacgctagcgggaggcctaacacatgcaagccgagcggtaggtttccttcgggagactgagagcggcgcacgggtgcggaacacgtgtgcaacctgcctttatcagggggatagcctttcgaaaggaagattaataccccataatattttgagtggcatcacttgaaattgaaaactccggtggataaagatgggcacgcgcaagattagatagttggtgaggtaacggctcaccaagtctacgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagctcaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttggggccttggcttcagagactaagcgaaagtgataagttagccacctggggagtacggacgcaagtctgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccagtacagagggcagctaccaggcgactggatgcgaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2678 - DNA, 1521 bp, Chryseobacterium rhizosphaerae
  ref <308>: DATABASE ACCESSION NUMBER: NCBI ACCESSION: NZ_QNUF01000059.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcggaatcttgagagcggcgtacgggtgcggaacacgtgtgcaacctgcctttatcagggagatagcctttcgaaaggaagattaataccccataatatattaagtggcatcacttgatattgaaaactacggtggatagagatgggcacgcgcaagattagatagttggtagggtaacggcctaccaagtctacgatctttagggggcctgagagggtgatcccccacactggtactgagacacggaccagactcctacgggaggcagcagtgaggaatattggacaatgggtgcaagcctgatccagccatcccgcgtgaaggacgacggccctatgggttgtaaacttcttttgtatagggataaacctagatacgtgtatctagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttggattttcggattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccagtacagagggcagctacacagcgatgtgatgcaaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2679 - DNA, 1523 bp, Chryseobacterium shigense
  ref <308>: DATABASE ACCESSION NUMBER: NCBI ACCESSION: NZ_UFVQ01000003.1
  ref <309>: DATABASE ENTRY DATE: 2019-04-01
  ref <313>: RELEVANT RESIDUES IN SEQ ID NO: (1)..(1523)
acaatggagagttttgatcctggctcaggatgaacgctagcgggaggcctaacacatgcaagccgagcggtaggtttccttcgggatactgagagcggcgcacgggtgcggaacacgtgtgcaacctgcctttatcagggggatagcctttcgaaaggaagattaataccccataatatatcatatggcatcatttgatattgaaaactacggtggataaagatgggcacgcgcaggattagatagttggtagggtaacggcctaccaagtcaacgatccttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggctgatttgtaagtcagtggtgaaatctcacagctcaactgtgaaactgccattgatactgcaagtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattgacgggggcccgcacaagcggtggattatgtggtttaattcgatgatacgccgaggaaccttaccaaggcttaaatgggaattgacaggtttagaaatagacttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccagtacagagggcagctacacagcgatgtgatgcaaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2680 - DNA, 1522 bp, Chryseobacterium sp. 52
  ref <308>: DATABASE ACCESSION NUMBER: NCBI ACCESSION: NZ_PEEX01000001.1
  ref <309>: DATABASE ENTRY DATE: 2019-04-01
  ref <313>: RELEVANT RESIDUES IN SEQ ID NO: (1)..(1522)
tacaatggagagtttgatcctggctcaggatgaacgctagcgggaggcctaacacatgcaagccgagcggtaggatctcttcggagatctgagagcggcgtacgggtgcggaacacgtgtgcaacctgcctttatcagggggatagcctttcgaaaggaagattaataccccataatatatttgatggcatcattagatattgaaaactacggtggataaagatgggcacgcgcaagattagatagttggtagggtaacggcctaccaagtctacgatctttagggggcctgagagggtgatcccccacactggtactgagacacggaccagactcctacgggaggcagcagtgaggaatattggacaatgggttaacgcctgatccagccatcccgcgtgaaggacgacggccctatgggttgtaaacttcttttgtatagggataaacctagatacgtgtatctagctgaaggtactatacgaataagcaccggctaactccgtgccagcagccgcggtaatacggagggtgcaagcgttatccggatttattgggtttaaagggtccgtaggctgatttgtaagtcagtggtgaaatctcacagctcaactgtgaaactgccattgatactgcaagtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgacaggtttagaaatagacttttcttcggacaattttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccagtacagagggcagctacacagcgatgtgatgcaaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaataggagctgcctagggtaaaacaggtaactagggctaagtcgtaacaaggtagccgtaccggaaggtgcggctggaacatctcattttaga

SEQ ID NO: 2681 - DNA, 1521 bp, Chryseobacterium sp. BLS98
  ref <308>: DATABASE ACCESSION NUMBER: NCBI ACCESSION: NZ_LFNF01000001.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcgggatcttgagagcggcgcacgggtgcggaacacgtgtgcaacctgcctttatcaggggaatagcctttcgaaaggaagattaatgccccataatatttagaatggcatcattttaaattgaaaactccggtggataaagatgggcacgcgcaggattagatagttggtagggtaacggcctaccaagtcagcgatccttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtacagggataaacctaccctcgtgagggtagctgaaggtactgtacgaataagcaccggctaactccgtgccagcagccgcggtaatacggagggtgcaagcgttatccggatttattgggtttaaagggtccgtaggcggactcgtaagtcagtggtgaaatctcacagcttaactgtgaaactgccattgatactgcgggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaattgacaggcttagaaataggcttttcttcggacaattttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2682 - DNA, 1521 bp, Chryseobacterium sp. CBTAP 102
  ref <308>: DATABASE ACCESSION NUMBER: NCBI ACCESSION: NZ_QICX01000026.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtatggatctttcgggattcagagagcggcgtacgggtgcggaacacgtgtgcaacctgcctttatcagggggatagcctttcgaaaggaagattaataccccataatatttagaatggcatcattttaaattgaaaactccggtggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgcgagcctgatccagccatcccgcgtgaaggacgacggccctatgggttgtaaacttcttttgtatagggataaacctaccctcgtgagggtagctgaaggtactatacgaataagcaccggctaactccgtgccagcagccgcggtaatacggagggtgcaagcgttatccggatttattgggtttaaagggtccgtaggctgatgtgtaagtcagtggtgaaatctcacagcttaactgtgaaactgccattgatactgcatgtcttgagtgttgttgaagtagctggaataagtagtgtagcggtgaaatgcatagatattacttagaacacccattgcgaaggcaggttactaagcaacaactgacgctgatggacgaaagcgtggggagcgaacaggattagataccctggtagtccacgccgtaaacgatgctaactcgtttttgggttttcggattcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacacagtgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2683 - DNA, 1522 bp, Chryseobacterium sp. FP211-J200
  ref <308>: DATABASE ACCESSION NUMBER: NCBI ACCESSION: NZ_LSHB01000005.1
  ref <309>: DATABASE ENTRY DATE: 2019-04-01
  ref <313>: RELEVANT RESIDUES IN SEQ ID NO: (1)..(1522)
acaatggagagtttgatcctggctcaggatgaacgctagcgggaggcctaacacatgcaagccgagcggtattcgtccttcgggacggagagagcggcgtacgggtgcggaacacgtgtgcaacctgcctttatctgggggatagcctttcgaaaggaagattaataccccataacatatgatacggcatcgtattatattgaaaactccggtggatagagatgggcacgcgcaagattagatagttggtgaggtaacggctcaccaagtcagtgatctttagggggcctgagagggtgatcccccacactggtactgagacacggaccagactcctacgggaggcagcagtgaggaatattggacaatgggtgagagcctgatccagccatcccgcgtgaaggactaaggccctatgggttgtaaacttcttttatactgggataaacctacttacgtgtaagtagttgaaggtacagtatgaataagcaccggctaactccgtgccagcagccgcggtaatacggagggtgcaagcgttatccggatttattgggtttaaagggtccgtaggcggatccgtaagtcagtggtgaaatctcatagcttaactatgaaactgccattgatactgcgggtcttgagtgagattgaggtagctggaataagtagtgtagcggtgaaatgcatagatattacttagaacaccaattgcgaaggcaggttaccaagtcttaactgacgctgagggacgaaagcgtggggagcgaacaggattagataccctggtagtccacgccgtaaacgatgctaactcgtttttggggccttgcgcttcagagactaagcgaaagtgataagttagccacctggggagtacgttcgcaagaatgaaactcaaaggaattgacgggggcccgcacaagcggtggagcatgtggtttaattcgatgatacgcgaggaaccttaccaagacttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgctaacattcagttgaggactctagtgagactgcctacgcaagtagagaggaaggtggggatgacgtcaaatcatcacggcccttacgtcttgggccacacacgtgctacaatggccagtacagagggcagctaccaggtgactggatgcgaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2684 - DNA, 1521 bp, Chryseobacterium sp. G0240
  ref <308>: DATABASE ACCESSION NUMBER: NCBI ACCESSION: NZ_RJTV01000030.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtatttgttcttcggaacagagagagcggcgtacgggtgcggaacacgtgtgcaacctgcctttatcagggggatagcctttcgaaaggaagattaataccccataatatattttacggcatcgtggaatattgaaaactgaggtggatagagatgggcacgcgcaagattagatagttggtgaggtaacggctcaccaagtcgacgatctttagggggcctgagagggtgatcccccacactggtactgagacacggaccagactcctacgggaggcagcagtgaggaatattggacaatgggttagcgcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggctgatttgtaagtcagtggtgaaatctcacagcttaactgtgaaactgccattgatactgcaagtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggttttcggattcagagactaagcgaaagtgataagttagccacctggggagtacgaacgcaagtttgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacacagtgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaataggagctgcctagggtaaaacaggtaactagggctaagtcgtaacaaggtagccgtaccggaaggtgcggctggaacatctcattttaga

SEQ ID NO: 2685 - DNA, 1521 bp, Chryseobacterium sp. JM1
  ref <308>: DATABASE ACCESSION NUMBER: NCBI ACCESSION: NZ_JPRN01000006.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtaggtttccttcgggagactgagagcggcgcacgggtgcggaacacgtgtgcaacctgcctttatcagggggatagcctttcgaaaggaagattaataccccataatattttgagtggcatcacttaaaattgaaaactccggtggataaagatgggcacgcgcaagattagatagttggtgaggtaacggctcaccaagtctacgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctttccacgtgtggaaagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggttttcggattcagagactaagcgaaagtgataagttagccacctggggagtacggacgcaagtctgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgccatcattcagttggggactctagtgagactgcctacgcaagtagagaggaaggtggggatgacgtcaaatcatcacggcccttacgccttgggccacacacgtaatacaatggccagtacagagggcagctaccaggcgactggatgcgaatctcgaaagctggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2686 - DNA, 1521 bp, Chryseobacterium sp. MYb7
  ref <308>: DATABASE ACCESSION NUMBER: NCBI ACCESSION: NZ_PCOU01000059.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcggaatcttgagagcggcgtacgggtgcggaacacgtgtgcaacctgcctttatctgggggatagcctttcgaaagggagattaataccccataatatatttatcggcatcgatgaatattgaaaactccggtggatagagatgggcacgcgcaagattagatagttggtgaggtaacggctcaccaagtctgcgatctttagggggcctgagagggtgatcccccacactggtactgagacacggaccagactcctacgggaggcagcagtgaggaatattggacaatgggtgagagcctgatccagccatcccgcgtgaaggacgacggccctatgggttgtaaacttcttttgtatagggataaacctactctcgtgagagtagctgaaggtactatacgaataagcaccggctaactccgtgccagcagccgcggtaatacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacaggattagataccctggtagtccacgccgtaaacgatgctaactcgtttttgggttttcggattcagagactaagcgaaagtgataagttagccacctggggagtacgttcgcaagaatgaaactcaaaggaattgacgggggcccgcacaagcggtggattatgtggtttaattcgatgatacgcgaggaaccttaccaaggcttaaatgggaaatgacaggtttagaaatagacttttcttcggacatttttcaaggtgctgcatggttgtcgtcagctcgtgccgtgaggtgttaggttaagtcctgcaacgagcgcaacccctgtcactagttgccatcattaagttggggactctagtgagactgcctacgcaagtagagaggaaggtggggatgacgtcaaatcatcacggcccttacgccttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtctggggtacctgaagtcggtgaccgtaacaggagctgcctagggtaaaacaggtaactagggctaagtcgtaacaaggtagccgtaccggaaggtgcggctggaacatctcattttaga

SEQ ID NO: 2687 - DNA, 1526 bp, Chryseolinea flava
  ref <308>: DATABASE ACCESSION NUMBER: NCBI ACCESSION: NZ_QMFY01000009.1
  ref <309>: DATABASE ENTRY DATE: 2019-04-01
  ref <313>: RELEVANT RESIDUES IN SEQ ID NO: (1)..(1526)
ttacaatggagagtttgatcctggctcaggatgaacgctagcggcaggcctaatacatgcaagtcgaacggtaaatattatagcaatatgatatgagagtgacgtacgggtgcgtaacacgtatgcaacctaccctttacaggcggatagctcggggaaactcgaattaacccgccgtggtataattgaatggcatcatttgattattaaaactccggtggtaaaggatgggcatgcgtctgattagttagttggcggtgtaacggaccaccaagacgatgatcagtaggggaactgagaggttgatcccccacactggcactgagatacgggccagactcctacgggaggcagcagtagggaatattggtcaatggatgcaagtctgaaccagccatgccgcgtgcaggaagaaggccttatgggttgtaaactgcttttgccaggggataaaatgagcgtgcgcgcttaattgaaggtacctggtgaataagccacggctaactacgtgccagcagccgcggtaatacgtaggtggcaagcgttgtccggatttattgggtttaaagggtgcgtaggcggtcttttaagtcagtgctgaaatactccagcttaactggaggggtggcattgatactggaagactggagtgtagtcgaagtaggcggaattgacggtgtagcggtgaaatgcttagatatcgtcaagaacaccgatagtgaagacagcttactaggctacaactgacgctgaggcacgaaagtgtggggatcaaacaggattagataccctggtagtccacactgtaaacgttgattactcgctgtgtgcgatatacagtacgcggccaagcgaaagcgataagtaatccacctggggagtacgccggcaacggtgaaactcaaaggaattgacgggggtccgcacaagcggtggagcatgtggtttaattcgatgatacgcgaggaaccttacctggactagaatgcccttgaccgatccagagatggatttttccgcaaggacaaggagcaaggtgctgcatggccgtcgtcagctcgtgccgtgaggtgttgggttaagtcccgcaacgagcgcaacccttattcttagttgccagcatgtcatggtggggactctaagaagactgcctgcgcaagcagagaggaaggaggggatgacgtcaggtcatcatggcccttacgtccagggctacacacgtgctacaatggcgtatacaaagtgttgccagctagcgatagcgagccaatcacaaaaagtacgtctcagttcggattgcaggctgcaactcgcctgcatgaagttggaatcgctagtaatcgcgcatcagcaatggcgcggtgaatacgttcccggaccttgtacacaccgcccgtcaagcgatggaagttgggaggacctgaagacagttgttgtaagacgctgtttagggttaaaccgatgactggcgctaagtcgtaacaaggtagccgtaccggaaggtgcggctggaacacctcctttct

SEQ ID NO: 2688 - DNA, 1524 bp, Chryseolinea serpens
  ref <308>: DATABASE ACCESSION NUMBER: NCBI ACCESSION: NZ_FQWQ01000006.1
  ref <309>: DATABASE ENTRY DATE: 2019-04-01
  ref <313>: RELEVANT RESIDUES IN SEQ ID NO: (1)..(1524)
ttacaatggagagtttgatcctggctcaggatgaacgctagcggcaggcctaatacatgcaagtcgaacggtaaatatttagcaatagatatgagagtgacgtacgggtgcgtaacacgtatgcaacctaccctttacaggcggatagctcggggaaactcgaattaacccgccgtaatataattggatggcatcatttgattattaaatctacggaggtaaaggatgggcatgcgtctgattagttagttggcggggtaacggcccaccaagacgatgatcagtaggggaactgagaggttgatcccccacactggcactgagatacgggccagactcctacgggaggcagcagtagggaatattggtcaatggatggaagtctgaaccagccatgccgcgtgcaggaagaaggccttctgggttgtaaactgcttttgccaggggataaaatgaccttgcgaggttaattgaaggtacctggtgaataagccacggctaactacgtgccagcagccgcggtaatacgtaggtggcaagcgttgtccggatttattgggtttaaagggtgcgtaggcggcttattaagtcagtggtgaaatactctagctcaactagaggggtgccattgatactgatgagcttgagtacagatgaggtaggcggaattgacggtgtagcggtgaaatgcttagatatcgtcaagaacacctatagcgaaggcagcttactaggctgtaactgacgctgaggcacgaaagtgtggggatcaaacaggattagataccctggtagtccacactgtaaacgttgattactcgctgtgtgcgatatacagtacgcggccaagcgaaagcgataagtaatccacctggggagtacgccggcaacggtgaaactcaaaggaattgacgggggtccgcacaagcggtggagcatgtggtttaattcgatgatacgcgaggaaccttacctggactagaatgcccttgaccgatccagagatggatttttccgcaaggacaaggagcaaggtgctgcatggccgtcgtcagctcgtgccgtgaggtgttgggttaagtcccgcaacgagcgcaacccctatttttagttgccaacaggttaagctggggactctaaaaagactgcccgcgcaagcggagaggaaggaggggacgacgtcaggtcatcatggcccttacgtccagggctacacacgtgctacaatggcgtatacagagtgttgcaaaccagcgatggtaagccaatcacaaaaagtacgtctcagttcggattgcaggctgcaactcgcctgcatgaagttggaatcgctagtaatcgcgcatcagcaatggcgcggtgaatacgttcccggaccttgtacacaccgcccgtcaagccatgagagtcgggaggacctgaaggcagttgctgtaaggcgctgtttagggttaaaccgatgattagggctaagtcgtaacaaggtagccgtaccggaaggtgcggctggaacacctcctttct

SEQ ID NO: 2689 - DNA, 1524 bp, Chryseolinea sp. KIS68-18
  ref <308>: DATABASE ACCESSION NUMBER: NCBI ACCESSION: NZ_CP032382.1
  ref <309>: DATABASE ENTRY DATE: 2019-04-01
  ref <313>: RELEVANT RESIDUES IN SEQ ID NO: (1)..(1524)
ttacaatggagagtttgatcctggctcaggatgaacgctagcggcaggcctaatacatgcaagtcgaacggtaaatatttagcaatagatatgagagtgacgtacgggtgcgtaacacgtatgcaacctaccctttacaggcggatagctcggggaaactcgaattaacccgccgtaacatcacggagtggcatcattttgtgattaaatctacggaggtaaaggatgggcatgcgtctgattagttagttggcggggtaacggcccaccaagacgatgatcagtaggggaactgagaggttgatcccccacactggcactgagatacgggccagactcctacgggaggcagcagtagggaatattggtcaatggatggaagtctgaaccagccatgccgcgtgcaggaagaaggccttctgggttgtaaactgcttttgccaggggataaaagtcccatgcgtgggaaattgaaggtacctggtgaataagccacggctaactacgtgccagcagccgcggtaatacgtaggtggcaagcgttgtccggatttattgggtttaaagggtgcgtaggcggcttattaagtcagtggtgaaatactctagctcaactagaggggtgccattgatactgatgagcttgagtacagatgaggtaggcggaattgacggtgtagcggtgaaatgcttagatatcgtcaagaacacctatagcgaaggcagcttactaggctgtaactgacgctgaggcacgaaagtgtggggatcaaacaggattagataccctggtagtccacactgtaaacgttgattactcgctgtgtgcgatatacagtacgcggccaagcgaaagcgataagtaatccacctggggagtacgccggcaacggtgaaactcaaaggaattgacgggggtccgcacaagcggtggagcatgtggtttaattcgatgatacgcgaggaaccttacctggactagaatgcccttgaccgatccagagatggatttttccgcaaggacaaggagcaaggtgctgcatggccgtcgtcagctcgtgccgtgaggtgttgggttaagtcccgcaacgagcgcaacccctatttttagttgccaacaggttaagctggggactctaaaaagactgcccgcgcaagcggagaggaaggaggggacgacgtcaggtcatcatggcccttacgtccagggctacacacgtgctacaatggcgtatacagagtgttgcaaaccagcgatggtaagccaatcacaaaaagtacgtctcagttcggattgcaggctgcaactcgcctgcatgaagttggaatcgctagtaatcgcgcatcagcaatggcgcggtgaatacgttcccggaccttgtacacaccgcccgtcaagccatgagagtcgggaggacctgaaggcagttgctgtaaggcgctgtttagggttaaaccgatgattagggctaagtcgtaacaaggtagccgtaccggaaggtgcggctggaacacctcctttct

SEQ ID NO: 2690 - DNA, 1337 bp, Chryseomicrobium excrementi
  ref <308>: DATABASE ACCESSION NUMBER: NCBI ACCESSION: NZ_PCGR01000010.1
  ref <309>: DATABASE ENTRY DATE: 2019-04-01
  ref <313>: RELEVANT RESIDUES IN SEQ ID NO: (1)..(1337)
cggctgtcactacaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatggacgaaagtctgatggagcaacgccgcgtgagtgaagaaggttctcggatcgtaaaactctgttgtgagggaagaacaagtaccggagtaactgccggtaccttgacggtacctcattagaaagccacggctaactacgtgccagcagccgcggtaatacgtaggtggcaagcgttgtccggaatcattgggcgtaaagcgcgcgcaggcggtcccttaagtctgatgtgaaagcccacggctcaaccgtggagggtcattggaaactgggggacttgagtgcagaagaggaaagcggaattccaagtgtagcggtgaaatgcgtagagatttggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgccgaccgcccaggagactgggccttcccttcggggacggcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcgaacccgcgagggggagccaatcccataaaaccattctcagttcggattgtaggctgcaactcgcctacatgaagctggaatcgctagtaatcgtggatcagcatgccacggtgaatacgttcccgggccttgtacacaccgcccgtcacaccacgagagtttgtaacacccgaagtcggtggggtaacctttatggagccagccgccgaaggtgggacagatgattggggtgaagtcgtaacaaggtagccgtatcggaaggtgcggctggatcacctcctttcta

SEQ ID NO: 2691 - DNA, 1518 bp, Chrysiogenes arsenatis
  ref <308>: DATABASE ACCESSION NUMBER: NCBI ACCESSION: NZ_AWNK01000005.1
  ref <309>: DATABASE ENTRY DATE: 2019-04-01
  ref <313>: RELEVANT RESIDUES IN SEQ ID NO: (1)..(1518)
tacggagagtttgatcctggctcaggacgaacgctggcggcgtgcctaacacatgcaagtcaagggtcatttcggtgacactggcgcacgggtgagtaacacgtggataatctacctttaagcctgggacaacagttggaaacgactgctaataccggatacgcactacggtggaaagatggtttcggccattgcttatagatgagtccgcgcatgattagctagttggcggggtaagagcccaccaaggcgaagatcattagccggcctgagagggtgatcggccacactgggactgagacacggcccagactcctacgggaggcagcagtggggaatattgcgcaatggacgtaagtctgacgcagcaacgccgcgtggatgatgaaggtcttcggatcgtaaagtcctttagatggtgaagaaccgatgtgagaggaaatgctcatatcctgacggtagccatagaataagctccggctaaatccgtgccagcagccgcggtaatacgggtggagcgagcgttgtccggaattattgggcgtaaagggtgcgtaggcggttttttaagtctgcattgtaagttcagtgcttaacgctgaaattggtgcggaaactggaagactagagtactgtaggggaaagcggaatgtccggtgtagcagtgaaatgcgtagagatcggatggaacaccgaaagcgaaggcagctttctgggcagtaactgacgctgaggcacgaaagcgtggggagcaaacaggattagataccctggtagtccacgccgtaaacgatggatgctagatgttggcgaggttaccttgtcagtgtcggagctaacgcaataagcatcccgcctggggagtacggtcgcaaggctgaaactcaaaggaattgacgggggcccgcacaagcggtggagcatgtggtttaattcgaagcaacgcgaagaaccttacctggtcttgacatccctttgctcggtatagagatatatctttcccttcggggacaagggtgacaggtgctgcacggctgtcgtcagctcgtgtcgtgagatgttgggttaagtcccgcaacgagcgcaacccctgctattagttgccatcattaagttgggcactctaatgggacagccggagtaatccggaggaaggtggggatgacgtcaagtcatcatggcccttatgaccagggctacacacgtgctacaatggcatggacaaagagaagcaaagccgcgaggtggagcaaacctcaaaaaccatgtcttagttcggattgcagtctgcaactcgactgcatgaagtcggaatcgctagtaatcgcaggtcagcacactgcggtgaatacgttcccgggccttgtacacaccgcccgtcacaccacgaaagtcggttttgccagaagcggatgaccgaatcgcaagataggaatcttccaaggcaggactggtgattggggtgaagtcgtaacaaggtagccgtatcggaaggtgcggctggatcacctcctttct

SEQ ID NO: 2692 - DNA, 1541 bp, Chthonomonas calidirosea
  ref <308>: DATABASE ACCESSION NUMBER: NCBI ACCESSION: NZ_CDLG01000001.1
  ref <309>: DATABASE ENTRY DATE: 2019-04-01
  ref <313>: RELEVANT RESIDUES IN SEQ ID NO: (1)..(1541)
acggagagtttgatcctggctcaggacgaacgctagcggcgtgcctaagaaatgcaagtcgagcggggagagctccgcaaggggttcttctagcggcgaacggtcgcgtaacgcgtaggcaacctgccctacaagaccgggataacacctcgaaaggggtgctaataccggatggtgtcgtacggaggcatctttgtacgatgaaaaccgggcgaagagccacgggcttgaggaggggcctgcgtcctatcagctagatggtggggtaacggcctaccatggcgacgacgggtagctggtctgagaggatggtcagccggactgggactgagacacggcccagactcctacgggaggcagcaattagggatcttgcgcaatgggggaaaccctgacgcagcgacgccgcgtggaggaggaaggccttcgggttgtaaactccttttcttggggaagaaggaagtgacggtacccaaggaagaagccccggctaactccgtgccagcagccgcggtaagacggagggggcgagcgttgtccggatttactgggcgtaaagggcgcgtaggcgggggagcgcgtctactgtaaaagtttggggctcagccccaaaaggtcggtagatacggctcttcttgaagcagctagggggagatggaattaccggtggagcggtgaaatgcgtagagatcggtaggaacacccgtggcgaaggcggtctcctggggctgtcttgacgctgaggcgcgaaagctgggggagcgaacgggattagataccccggtagtcccagccctaaacgatggatactaggtgtcaggggtatcgactcctctggtgccgtcgctaacgcagtaagtatcccgcctggggagtacggccgcaaggttgaaactcaaaggaattgacgggggcccgcacaagcggtggagcatgttgtttaatacgtcacaaaccgtagaaccttaccagggcttgacatgcggcgcaccgtggtgagagccacgttctccgcaaggggacgccgacacaggtgttgcatggctgtcgtcagctcgtgtcgtgagatgttgggttaagtcccgcaacgagcgcaacccccatcccatgttgccatcgggtagtgccgggcactcttgggaaactgccggggtaactcggaggaaggtggggatgacgtcaagtcagcatggcccttacgccctgggctacaaacatgctacaatggacggtagacagagggttccgaactcgtgagggggaggcaatcccaaaaatccgtccacagttcagatcgcaggctgcaactcgcctgcgtgaagtcggaatcgctagtaaccgcagatcagcgaagctgcggtgaatacgttcccgggccttgtacacaccgcccgtcacgtcacctgagttgcctgcacccgaagtcggtggggcaaccccgcaaggggagctagccgccgaaggtgtggggagcgagggggacgaagtcgtaacaaggtagccgtaccggaaggtgcggctggatcacctcctttctaagg

SEQ ID NO: 2693 - DNA, 1493 bp, Ciceribacter sp. F8825
  ref <308>: DATABASE ACCESSION NUMBER: NCBI ACCESSION: NZ_SDVB01000404.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgccccgcaaggggagcggcagacgggtgagtaacgcgtgggaatctacccatccctacggaacaactccgggaaactggagctaataccgtatacgcccttagggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcatgtaggcggacatttaagtcaggggtgaaatcccggggctcaacctcggaactgcctttgatactgggtgtctagagtgtggaagaggtaagtggaattccgagtgtagaggtgaaattcgtagatattcggaggaacaccagtggcgaaggcggcttactggtccattactgacgctgaggtgcgaaagcgtggggagcaaacaggattagataccctggtagtccacgccgtaaacgatgaatgttagccgtcgggcagttgactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacatctgggtcgcggttaccggagacggtaatcttcagttcggctggacccgagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaacccgcaagggaggcagctaaccacggtagggtcagcgactggggtgaagtcgtaacaaggtagccgtaggggaacctgcggctggatcacctcctttctaag

SEQ ID NO: 2694 - DNA, 1467 bp, Citreicella sp. 357
  ref <308>: DATABASE ACCESSION NUMBER: NCBI ACCESSION: NZ_AJKJ01000163.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggtgagtaacgcgtgggaatatgcccttctgtgcggaatagcctcgggaaactgagagtaataccgcatacgcccttcgggggaaagatttatcgcagaaggattagcccgcgttggattaggtagttggtggggtaatggcctaccaagcctacgatccatagctggtttgagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggactggaaagttgggggtgaaatcccggggctcaacctcggaactgccttcaaaactcccagtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagacgtcagcaagcatgcttgttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgctggagagatccagctttctcgtaagagaccgagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatcaacaatgggttaatcccaaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 2695 - DNA, 1467 bp, Citreicella sp. SE45
  ref <308>: DATABASE ACCESSION NUMBER: NCBI ACCESSION: NZ_GG704604.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcaccttcgggtgagcggcggacgggtgagtaacgcgtgggaacgtgcccttctctgcggaatagccactggaaacggtgagtaataccgcatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggcgcaagcctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaacctcggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatctggctttcacttcggtgacctagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggtgcctacagtgggttaatccccaaaaggcatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgaagacggtgcgccaacctttcgagggggcagctggccacggtaggctcagcgactggggtgaagtcgtaacaaggtagccgtaggggaacctgcggctggatcacctcctttctaa

SEQ ID NO: 2696 - DNA, 1704 bp, Citricoccus massiliensis
  misc_feature (339)..(339): n is a, c, g, or t
  ref <308>: DATABASE ACCESSION NUMBER: NCBI ACCESSION: NZ_LT966071.1
  ref <309>: DATABASE ENTRY DATE: 2019-04-01
  ref <313>: RELEVANT RESIDUES IN SEQ ID NO: (1)..(1704)
tttttggagagtttgatcttggctcaggacgaacgctggcggcgtgcctaatacatgcaagtcgagcgcgggaagcaagcggaaaccttcgggaggacgcttgtggaacgagcggcggacgggtgagtaacacgtgggcaacctgcctgtaagatcgggataactccgggaaaccggggctaataccggataataccttttctcgcatggagagaagttgaaagatggcttcggctatcgcttacagatgggcccgcggcgcattagctagttggtagggtaacggcctaccaaggcaacgatgcgtagccgacctgagagggtgatcggccacactgnctcgcgtggggagaagttgaaagatggcttcggctatcgcttacagatgggcccgcggcgcattagctagttggtagggtaacggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtgagggaagaacaagtaccgttcgaagagggcggtaccgtgacggtacctcaccagaaagccccggctaactacgtgccagcagccgcggtaatacgtagggggcaagcgttgtccggaattattgggcgtaaagcgcgcgcaggcggtcttttaagtctgatgtgaaatctcgcggctcaaccgcgagcggtcattggaaactggaggacttgagtgcagaagaggagagtggaattccacgtgtagcggtgaaatgcgtagagatgtggaggaacaccagtggcgaaggcgactctctggtctgtaactgacgctgaggtgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgctagcgctagagatagcgtgttcccttcggggacagagagacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggcagcgaagccgcgaggtgaagcaaatcccataaaaccattcccagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaaccatttggagccagccgccgaaggtggggccaatgattggggtgaagtcgtaacaaggtagccgtatcggaaggtgcggctggatcacctcctttcta

SEQ ID NO: 2697 - DNA, 1535 bp, Citricoccus muralis
  ref <308>: DATABASE ACCESSION NUMBER: NCBI ACCESSION: NZ_QREH01000001.1
  ref <309>: DATABASE ENTRY DATE: 2019-04-01
  ref <313>: RELEVANT RESIDUES IN SEQ ID NO: (1)..(1535)
ttttacggagagtttgatcctggctcaggatgaacgctggcggcgtgcttaacacatgcaagtcgaacgctgaagctccagcttgctggggtggatgagtggcgaacgggtgagtaacacgtgagtaaccttcccttgactctgggataagcccgggaaactgggtctaataccggatacgacctcctatcgcatggtggggggtggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagctttcgggtgacggtacctgcagaagaagcgccggctaactacgtgccagcagccgcggtaatacgtagggcgcgagcgttatccggaattattgggcgtaaagagctcgtaggcggtttgtcgcgtctgccgtgaaagtccggggcttaaccccggatctgcggtgggtacgggcagactagagtgcagtaggggagaccggaattcctggtgtagcggtgaaatgcgcagatatcaggaggaacaccgatggcgaaggcaggtctctgggctgttactgacgctgaggagcgaaagcatggggagcgaacaggattagataccctggtagtccatgccgtaaacgttgggcactaggtgtgggggacattccacgttttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttcccgaccgggccagagatggtctttcccctttggggcgggttcacaggtggtgcatggttgtcgtcagctcgtgtcgtgagatgttgggttaagtcccgcaacgagcgcaaccctcgttccatgttgccagcgggttatgccggggactcatgggagactgccggggtcaactcggaggaaggtggggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagtcggtaacacccgaagccggtggcccaacccttgtggggggagccgtcgaaggtgggactggcgattgggactaagtcgtaacaaggtagccgtaccggaaggtgcggctggatcacctcctttctaagga

SEQ ID NO: 2698 - DNA, 1552 bp, Citrobacter amalonaticus
  ref <308>: DATABASE ACCESSION NUMBER: NCBI ACCESSION: NZ_RCYA01000028.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggttaaggttaataaccttagccattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 2699 - DNA, 822 bp, Citrobacter farmeri
  ref <308>: DATABASE ACCESSION NUMBER: NCBI ACCESSION: NZ_RHWV01000018.1
  ref <309>: DATABASE ENTRY DATE: 2019-04-01
  ref <313>: RELEVANT RESIDUES IN SEQ ID NO: (1)..(822)
gtcgcaagaccaaagagggggaccttcgggcctcttgccatcggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggggatgtggttaataaccgcattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaa

SEQ ID NO: 2700 - DNA, 1552 bp, Citrobacter gillenii
  ref <308>: DATABASE ACCESSION NUMBER: NCBI ACCESSION: NZ_QVEK01000029.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtagcacagaggagcttgctccttgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggggatgtggttaataaccgcattcattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 2701 - DNA, 1552 bp, Citrobacter koseri
  ref <308>: DATABASE ACCESSION NUMBER: NCBI ACCESSION: NZ_UFVW01000001.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagcttgttggtggggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgtggttaataaccgcagcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatctgatactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 2702 - DNA, 1554 bp, Citrobacter pasteurii
  ref <308>: DATABASE ACCESSION NUMBER: NCBI ACCESSION: NZ_CP024676.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaacttgccagagatggcttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 2703 - DNA, 1552 bp, Citrobacter sp. 50677481
  ref <308>: DATABASE ACCESSION NUMBER: NCBI ACCESSION: NZ_LNHZ01000037.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcccggtggagggggataactactggaaacggtagctaataccgcataacgtcgcaagaccaaagagggggaccttcgggcctcttgccaccggatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggattgtggttaataaccgcagtcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctacttggaggctgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacggaagactgcagagatgcggttgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 2704 - DNA, 449 bp, Citrobacter sp. MH181794
  ref <308>: DATABASE ACCESSION NUMBER: NCBI ACCESSION: NZ_RAPH01000026.1
  ref <309>: DATABASE ENTRY DATE: 2019-04-01
  ref <313>: RELEVANT RESIDUES IN SEQ ID NO: (1)..(449)
gtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgtggttaataaccgcagcaattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaact

SEQ ID NO: 2705 - DNA, 1550 bp, Citrobacter werkmanii
  ref <308>: DATABASE ACCESSION NUMBER: NCBI ACCESSION: NZ_SEJH01000041.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccacagcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 2706 - DNA, 1554 bp, Citrobacter youngae
  ref <308>: DATABASE ACCESSION NUMBER: NCBI ACCESSION: NZ_LR134485.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtagcacagaggagcttgctccttgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggtgttgaggttaataacctcagcaattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 2707 - DNA, 1490 bp, Citromicrobium bathyomarinum
  ref <308>: DATABASE ACCESSION NUMBER: NCBI ACCESSION: NZ_ADAE01000015.1
  ref <309>: DATABASE ENTRY DATE: 2019-04-01
  ref <313>: RELEVANT RESIDUES IN SEQ ID NO: (1)..(1490)
caaacttgagagtttgatcctggctcagaacgaacgctggcggcatgcctcatacatgcaagtcgaacgaagtcttcggacttagtggcgaacgggtgcgtaacgcgtgggaacctgcccttaggttcggaataacagttagaaatgactgctaatgccggataatgtcttcggaccaaagatttatcgcctttggatgggcccgcgtaggattaggtagttggtgaggtaaaggctcaccaagccgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgatgactagttgtccgggctcatagagcttgggtgacgcagttaacgcattaagtcatccgcctggggagtacggtcgcaagattaaaactcaaaggaattgacgggggcctgcacaagcggtggagcatgtggtttaattcgaagcaacgcgcagaaccttaccagcctttgacatcctaggacgatttctggagacagatctcttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagctatcacgcaagtgtgagctaatctccaaaagatgtctcagttcggattgtcgtctgcaactcgacggcatgaaggcggaatcgctagtaatcgcggatcagcatgccgcggtgaatacgttcccaggccttgtacacaccgcccgtcacatcatgggagttggtttcacccgaagatcgtgcgctaacctttggaggcagcgagccacggtgggatcagcgactgggatgaagtcgtaacaaggtagccgtaggggaacctgcggctggatcacctcctttctaag

SEQ ID NO: 2708 - DNA, 1492 bp, Citromicrobium sp. JL1351
  ref <308>: DATABASE ACCESSION NUMBER: NCBI ACCESSION: NZ_LAPR01000014.1
  ref <309>: DATABASE ENTRY DATE: 2019-04-01
  ref <313>: RELEVANT RESIDUES IN SEQ ID NO: (1)..(1492)
caaacttgagagtttgatcctggctcagaacgaacgctggcggcatgcctcatacatgcaagtcgaacgaagtcttcggacttagtggcgaacgggtgcgtaacgcgtgggaacctgcccttaggttcggaataacagttagaaatgactgctaatgccggataatgtcttcggaccaaagatttatcgcctttggatgggcccgcgtaggattaggtagttggtgaggtaaaggctcaccaagccgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgatgactagttgtccgggctcatagagcttgggtgacgcagttaacgcattaagtcatccgcctggggagtacggtcgcaagattaaaactcaaaggaattgacgggggcctgcacaagcggtggagcatgtggtttaattcgaagcaacgcgcagaaccttaccagcctttgacatcctaggacgatttctggagacagatctcttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagctatcacgcaagtgtgagctaatctccaaaagatgtctcagttcggattgtcgtctgcaactcgacggcatgaaggcggaatcgctagtaatcgcggatcagcatgccgcggtgaatacgttcccaggccttgtacacaccgcccgtcacatcatgggagttggtttcacccgaagatcgtgcgctaacctttggaggcagcgagccacggtgggatcagcgactgggatgaagtcgtaacaaggtagccgtaggggaacctgcggctggatcacctcctttctaagga

SEQ ID NO: 2709 - DNA, 1492 bp, Citromicrobium sp. JL2201; identical to SEQ ID NO: 2708
  ref <308>: DATABASE ACCESSION NUMBER: NCBI ACCESSION: NZ_LARQ01000020.1
  ref <309>: DATABASE ENTRY DATE: 2019-04-01
  ref <313>: RELEVANT RESIDUES IN SEQ ID NO: (1)..(1492)

SEQ ID NO: 2710 - DNA, 1492 bp, Citromicrobium sp. JL31; identical to SEQ ID NO: 2708
  ref <308>: DATABASE ACCESSION NUMBER: NCBI ACCESSION: NZ_LAIH01000019.1
  ref <309>: DATABASE ENTRY DATE: 2019-04-01
  ref <313>: RELEVANT RESIDUES IN SEQ ID NO: (1)..(1492)

SEQ ID NO: 2711 - DNA, 1492 bp, Citromicrobium sp. JL477; identical to SEQ ID NO: 2708
  ref <308>: DATABASE ACCESSION NUMBER: NCBI ACCESSION: NZ_CP011344.1
  ref <309>: DATABASE ENTRY DATE: 2019-04-01
  ref <313>: RELEVANT RESIDUES IN SEQ ID NO: (1)..(1492)

SEQ ID NO: 2712 - DNA, 1495 bp, Citromicrobium sp. JLT1363
  ref <308>: DATABASE ACCESSION NUMBER: NCBI ACCESSION: NZ_AEUE01000008.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctcatacatgcaagtcgaacgaagccttcgggcttagtggcgaacgggtgcgtaacgcgtgggaacctgcccttaggttcggaataacagttagaaatgactgctaatgccggataatgtcttcggaccaaagatttatcgcctttggatgggcccgcgtaggattaggtagttggtgtggtaatggcgcaccaagccgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctatccaagtcaggggtgaaatcccggggctcaaccccggaactgcccttgaaactagatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgatgactagttgtccgggctcttagagcttgggtgacgcagttaacgcattaagtcatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagactccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagcgaactcgcaagggtgagctaatctccaaaagatgtctcagttcggattgtcgtctgcaactcgacggcatgaaggcggaatcgctagtaatcgcggatcagcatgccgcggtgaatacgttcccaggccttgtacacaccgcccgtcacatcatgggagttggtttcacccgaagatcgtgcgcgaacccgcaagggacgcagcgagccacggtgggatcagcgactgggatgaagtcgtaacaaggtagccgtaggggaacctgcggctggatcacctcctttctaagga

SEQ ID NO: 2713 - DNA, 1492 bp, Citromicrobium sp. RCC1878; identical to SEQ ID NO: 2708
  ref <308>: DATABASE ACCESSION NUMBER: NCBI ACCESSION: NZ_LBLZ01000010.1
  ref <309>: DATABASE ENTRY DATE: 2019-04-01
  ref <313>: RELEVANT RESIDUES IN SEQ ID NO: (1)..(1492)

SEQ ID NO: 2714 - DNA, 1492 bp, Citromicrobium sp. RCC1885; identical to SEQ ID NO: 2708
  ref <308>: DATABASE ACCESSION NUMBER: NCBI ACCESSION: NZ_LBLY01000010.1
  ref <309>: DATABASE ENTRY DATE: 2019-04-01
  ref <313>: RELEVANT RESIDUES IN SEQ ID NO: (1)..(1492)

SEQ ID NO: 2715 - DNA, 1492 bp, Citromicrobium sp. RCC1897; identical to SEQ ID NO: 2708
  ref <308>: DATABASE ACCESSION NUMBER: NCBI ACCESSION: NZ_LUGI01000007.1
  ref <309>: DATABASE ENTRY DATE: 2019-04-01
  ref <313>: RELEVANT RESIDUES IN SEQ ID NO: (1)..(1492)

SEQ ID NO: 2716 - DNA, 1492 bp, Citromicrobium sp. WPS32; identical to SEQ ID NO: 2708
  ref <308>: DATABASE ACCESSION NUMBER: NCBI ACCESSION: NZ_LAPS01000003.1
  ref <309>: DATABASE ENTRY DATE: 2019-04-01
  ref <313>: RELEVANT RESIDUES IN SEQ ID NO: (1)..(1492)

SEQ ID NO: 2717 - DNA, 1528 bp, Clavibacter sp. 199
  ref <308>: DATABASE ACCESSION NUMBER: NCBI ACCESSION: NZ_QTTK01000005.1
  ref <309>: DATABASE ENTRY DATE: 2019-04-01
  ref <313>: RELEVANT RESIDUES IN SEQ ID NO: (1)..(1528)
tttatggagagtttgatcctggctcaggacgaacgctggcggcgtgcttaacacatgcaagtcgaacggtgatgtcagagcttgctctggcggatcagtggcgaacgggtgagtaacacgtgagtaacctgcccccgactctgggataactgctagaaatggtagctaataccggatatgacgactggccgcatggtctggtcgtggaaagaacttcggttggggatggactcgcggcctatcaggttgttggtgaggtaatggctcaccaagcctacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacatgcagagatgtgtgccccgcaaggtcggtatacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaagggaggagctgtcgaaggtgggatcggtgattaggactaagtcgtaacaaggtagccgtaccggaaggtgcggctggatcacctcctttctaagga

SEQ ID NO: 2718 - DNA, 1528 bp, Clavibacter sp. CFBP 8615
  ref <308>: DATABASE ACCESSION NUMBER: NCBI ACCESSION: NZ_QWGT01000193.1
  ref <309>: DATABASE ENTRY DATE: 2019-04-01
  ref <313>: RELEVANT RESIDUES IN SEQ ID NO: (1)..(1528)
tttatggagagtttgatcctggctcaggacgaacgctggcggcgtgcttaacacatgcaagtcgaacggtgatgtcagagcttgctctggcggatcagtggcgaacgggtgagtaacacgtgagtaacctgcccccgactctgggataactgctagaaatggtagctaataccggatatgacgactggccgcatggtctggtcgtggaaagaatttcggttggggatggactcgcggcctatcaggttgttggtgaggtaatggctcaccaagcctacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacgtgcagagatgtgcgccccgcaaggtcggtatacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaaccgcaagggaggagctgtcgaaggtgggatcggtgattaggactaagtcgtaacaaggtagccgtaccggaaggtgcggctggatcacctcctttctaagga

SEQ ID NO: 2719 - DNA, 1528 bp, Clavibacter sp. CFBP 8616; identical to SEQ ID NO: 2718
  ref <308>: DATABASE ACCESSION NUMBER: NCBI ACCESSION: NZ_QWGU01000173.1
  ref <309>: DATABASE ENTRY DATE: 2019-04-01
  ref <313>: RELEVANT RESIDUES IN SEQ ID NO: (1)..(1528)

SEQ ID NO: 2720 - DNA, 1527 bp, Cloacibacillus evryensis
  ref <308>: DATABASE ACCESSION NUMBER: NCBI ACCESSION: NZ_KK073872.1
  ref <309>: DATABASE ENTRY DATE: 2019-04-01
  ref <313>: RELEVANT RESIDUES IN SEQ ID NO: (1)..(1527)
aacggagagtttgatcctggctcaggacgaacgctggcggcgtgcctaacacatgcaagtcgaacgaagaccatagaggagcttgctttaatatggttttagtggcggacgggtgagtaacgcgtgaggacttgtcgagtacagggggacaacaggtggaaacgtctgctaataccccataagccttcgggtaaaaggagcgatccggtacacgagagactcgcgttctatcagctagtaggtggggtaacggcccacccaggccaagacggatagccggactgagaggtcgatcggccacactggaactgagacacggtccagactcctacgggaggcagcagtggggaatattgggcaatgggggaaaccctgacccagcgacgccgcgtgagtgaagaaatccctcgggatgtaaaactctgttgtgtgggaagataatgacggtaccacacgaggaagccccggcaaactacgtgccagcagccgcggtaatacgtagggggcgagcgttgttcggaattactgggcgtaaagcgcacgcaggcggacctgtaagtctgtcgtcaaaggcggaggctcaaccttcgttctacgatagataactgcgggtctagagtatgtgagagggaagtggaattcccggtgtagcggtgaaatgcgtagatatccgggaggaacaccagtggcgaaggcggcttcctggcacacaactgacgctcatgtgcgaaagccagggcagcgaacgggtattagactaccccggtagtcctggaccgtaaacgatggatacgtgggtgtgggtgaagcagttcatccgtgccgtagttaacgcgttaagtatcccgcctggggactacggtcgcaagactgaaactcaaaggaattgacgggggcccgcacaagcggtggagcacgtggtttaattcgatgcaaaccgaagaaccttacctgggtttgacatactaccggtactgacctgaaagggaagggaccccagcttgctggggaagtagaacaggtgctgcatggctgtcgtcagctcgtgtcgtgagatgttgggttaagtcccgcaacgagcgcaacccctatagccagttgctaacaagtgaagttgagcactctggcgagactgccgccgacaaggcggaggaaggtggggatgacgtcaagtcatcatggcctttatgcccagggcgacacacgtgctacaatggacggcacaaaaggcagcttactagcgatagttggcgaatccttgaaagccgttcccagttcggattgcagtctgaaacccgactgcatgaagccggaatcgctagtaatcgcagatcagccaagctgcggtgaatacgttcccgggccttgtacacaccgcccgtcacaccacccgagttgggggcacccgaagccgcaggcttaacccgtaagggaaagaagcgtctaaggtgcgccgagtaaggggggtgaagtcgtaacaaggtagccgtaccggaaggtgcggctggatcacctcctttctaagga

SEQ ID NO: 2721 - DNA, 1521 bp, Cloacibacillus porcorum
  ref <308>: DATABASE ACCESSION NUMBER: NCBI ACCESSION: NZ_CP016757.1
  ref <309>: DATABASE ENTRY DATE: 2019-04-01
  ref <313>: RELEVANT RESIDUES IN SEQ ID NO: (1)..(1521)
aacggagagtttgatcctggctcaggacgaacgctggcggcgtgcctaacacatgcaagtcgaacgaaattacgaagaaagcttgctttaatcgtaatttagtggcggacgggtgagtaacgcgtgaggacttgtcggatacagggggacaacagatggaaacgtctgctaataccccataagccttcgggtaaaaggagcaatccggtatctgagagactcgcgttctatcagctagtaggtggggtaacggcccacctaggccaagacggatagccggactgagaggtcgaccggccacactggaactgagagacggtccagactcctacgggaggcagcagtggggaatattgggcaatgggggcaaccctgacccagcgacgccgcgtgggtgaagaaatccttcgggatgtaaagccctgttgtgtgggaagataatgacggtaccacacgaggaagccccggcaaactacgtgccagcagccgcggtaatacgtagggggcgagcgttgttcggaattactgggcgtaaagcgcacgcaggctgaccgttaagtctgtcgtcaaaggcggaggctcaaccttcgttctacgatagatactggcggtctagagtatgtgagagggaagtggaattcccggtgtagcggtgaaatgcgtagatatcgggaggaacaccagtggcgaaggcggcttcctggcacacaactgacgctcatgtgcgaaagccagggcagcgaacgggattagataccccggtagtcctggccgtaaacgatggatactgggtgtgggtgaagcagttcatccgtgccgtagttaacgcgttaagtatcccgcctggggactacggtcgcaagactgaaactcaaaggaattgacgggggcccgcacaagcggtggagcacgtggtttaattcgatgcaaaccgaagaaccttacctgggtttgacatacaagtggtactgagatgaaagttgagggactgtagcttgctacagagcttgaacaggtgctgcatggctgtcgtcagctcgtgtcgtgagatgttgggttaagtcccgcaacgagcgcaacccctatgtccagttgctaacaagtgaagttgagcactctggagagactgccgccgacaaggcggaggaaggtggggatgacgtcaagtcatcatggcctttatgcccagggcgacacacgtgctacaatggccggcacagaaggcagcttgctagtgatagttggcgaatccttaaaagccggtcccagttcggattgtagtctgcaacccgactacatgaagccggaatcgctagtaatcgcagatcagccaagctgcggtgaatacgttcccgggccttgtacacaccgcccgtcacaccacccgagttgggggcacccgaagccgcaggcttaacccgtaagggaaagaagcgtctaaggtgcgccgagtaaggggggtgaagtcgtaacaaggtagccgtaccggaaggtgcggctggatcacctcctttctaagga

SEQ ID NO: 2722 - DNA, 1535 bp, Clostridia bacterium UC5.1-1D1
  ref <308>: DATABASE ACCESSION NUMBER: NCBI ACCESSION: NZ_BCAB01000048.1
  ref <309>: DATABASE ENTRY DATE: 2019-04-01
  ref <313>: RELEVANT RESIDUES IN SEQ ID NO: (1)..(1535)
atttttagagagtttgatcctggctcaggatgaacgctggcggcgtgcctaacacatgcaagtcgaacggggttattttggaaatctcttcggagatggaattcttaacctagtggcggacgggtgagtaacgcgtgagcaatctgcctttaggagggggataacagtcggaaacggctgctaataccgcataatacgtttgggaggcatctcttgaacgtcaaagattttatcgcctttagatgagctcgcgtctgattagctggttggcggggtaacggcccaccaaggcgacgatcagtagccggactgagaggttgaacggccacattgggactgagacacggcccagactcctacgggaggcagcagtggggaatattgcgcaatgggggaaaccctgacgcagcaacgccgcgtgattgaagaaggcctcgggttgtaaagatctttaatcagggacgaaaaatgacggtacctgaagaataagctccggctaactacgtgccagcagccgcggtaatacgtagggagcaagcgttatccggatttactgggtgtaaagggcgcgcaggcgggccggcaagttgggagtgaaatcccggggcttaaccccggaactgctttcaaaactgctggtcttgagtgatggagaggcaggcggaattccgtgtgtagcggtgaaatgcgtagatatacggaggaacaccagtggcgaaggcggcctgctggacattaactgacgctgaggcgcgaaagcgtggggagcaaacaggattagataccctggtagtccacgccgtaaacgatggatactaggtgtgggaggtattgaccccttccgtgccgcagttaacacaataagtatcccacctggggagtacggccgcaaggttgaaactcaaaggaattgacgggggcccgcacaagcagtggagtatgtggtttaattcgaagcaacgcgaagaaccttaccaggtcttgacatcccgatgaccggcgtagagatacgccctctcttcggagcatcggtgacaggtggtgcatggttgtcgtcagctcgtgtcgtgagatgttgggttaagtcccgcaacgagcgcaacccttacggttagttgatacgcaagatcactctagccggactgccgttgacaaaacggaggaaggtggggacgacgtcaaatcatcatgccccttatgacctgggctacacacgtactacaatggcagtcatacagagggaagcaataccgcgaggtggagcaaatccctaaaagctgtcccagttcagattgcaggctgcaacccgcctgcatgaagtcggaattgctagtaatcgcggatcagcatgccgcggtgaatacgttcccgggccttgtacacaccgcccgtcacaccatgagagccgtcaatacccgaagtccgtagcctaaccgcaaggggggcgcggccgaaggtaggggtggtaattagggtgaagtcgtaacaaggtagccgtatcggaaggtgcggctggatcacctcctttctaagga

SEQ ID NO: 2723 - DNA, 1516 bp, Clostridia bacterium UC5.1-2F7
  ref <308>: DATABASE ACCESSION NUMBER: NCBI ACCESSION: NZ_BBZZ01000024.1
  ref <309>: DATABASE ENTRY DATE: 2019-04-01
  ref <313>: RELEVANT RESIDUES IN SEQ ID NO: (1)..(1516)
tttatctaagagtttgatcctggctcaggacgaacgctggcggcgcgcctaacacatgcaagtcgaacgagccgaggggagcttgctccccagagctagtggcggacgggtgagtaacacgtgagcaacctgcctttcagagggggataacgtttggaaacgaacgctaataccgcataacataccgggaccgcatgattctggtatcaaaggagcaatccgctgaaagatgggctcgcgtccgattagctagttggcggggtaacggcccaccaaggcgacgatcggtagccggactgagaggttgatcggccacattgggactgagacacggcccagactcctacgggaggcagcagtgggggatattgcacaatggaggaaactctgatgcagcgacgccgcgtgagggaagacggtcttcggattgtaaacctctgtctttggggacgataatgacggtacccaaggaggaagctccggctaactacgtgccagcagccgcggtaatacgtagggagcgagcgttgtccggaattactgggtgtaaagggagcgtaggcggggtctcaagtcgaatgttaaatctaccggctcaactggtagctgcgttcgaaactggggctcttgagtgaagtagaggcaggcggaattcctagtgtagcggtgaaatgcgtagatattaggaggaacaccagtggcgaaggcggcctgctgggcttttactgacgctgaggctcgaaagcgtggggagcaaacaggattagataccctggtagtccacgccgtaaacgatgattactaggtgtgggggactgaccccttccgtgccggagttaacacaataagtaatccacctggggagtacgaccgcaaggttgaaactcaaaggaattgacgggggcccgcacaagcagtggattatgtggtttaattcgaagcaacgcgaagaaccttaccaggtcttgacatcgagtgacggctctagagatagagctttccttcgggacacaaagacaggtggtgcatggttgtcgtcagctcgtgtcgtgagatgttgggttaagtcccgcaacgagcgcaacccttattattagttgctacattcagttgagcactctaatgagactgccgttgacaaaacggaggaaggtggggatgacgtcaaatcatcatgccccttatgacctgggctacacacgtaatacaatggcgatcaacagagggaagcaagaccgcgaggtggagcaaacccctaaaagtcgtctcagttcggattgcaggctgcaactcgcctgcatgaagtcggaattgctagtaatcgcggatcagcatgccgcggtgaatacgttcccgggccttgtacacaccgcccgtcacaccatgggagtcggtaacacccgaagtcagtagcctaaccgcaaagagggcgctgccgaaggtgggattgatgactggggtgaagtcgtaacaaggtagccgtatcggaaggtgcggctggatcacctcctttcta

SEQ ID NO: 2724 - DNA, 1542 bp, Clostridia bacterium UC5.1-2G4
  ref <308>: DATABASE ACCESSION NUMBER: NCBI ACCESSION: NZ_BBZY01000137.1
  ref <309>: DATABASE ENTRY DATE: 2019-04-01
  ref <313>: RELEVANT RESIDUES IN SEQ ID NO: (1)..(1542)
caaatggagagtttgatcctggctcaggatgaacgctggcggcatgcctaatacatgcaagtcgaacgaagtttcgaggaagcttgcttccaaagagacttagtggcgaacgggtgagtaacacgtaggtaacctgcccatgtgtccgggataactgctggaaacggtagctaaaaccggataggtatacagagcgcatgctcagtatattaaagcgcccatcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctggagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagagagataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacacagtgatgtgaagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctcctttct

SEQ ID NO: 2725 - DNA, 1333 bp, Clostridiaceae bacterium AF02-42
  ref <308>: DATABASE ACCESSION NUMBER: NCBI ACCESSION: NZ_QWGK01000068.1
  ref <309>: DATABASE ENTRY DATE: 2019-04-01
  ref <313>: RELEVANT RESIDUES IN SEQ ID NO: (1)..(1333)
catggtacggtgtgaaaaactccggtggtatgagatggacccgcgtctgattagctagttggtggggtaacggcccaccaaggcgacgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaaagcctttaatcgggctcctccttcgggacagaggtgacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 2726 - DNA, 1540 bp, Clostridiaceae bacterium AF18-31LB
  ref <308>: DATABASE ACCESSION NUMBER: NCBI ACCESSION: NZ_QUGS01000007.1
  ref <309>: DATABASE ENTRY DATE: 2019-04-01
  ref <313>: RELEVANT RESIDUES IN SEQ ID NO: (1)..(1540)
tttaatcgagagtttgatcctggctcaggatgaacgctggcggcgtgcttaacacatgcaagtcgaacgaagcacttaagattgattcttcggatgacgtcttttgtgacttagtggcggacgggtgagtaacgcgtgggtaacctgcctcacacagggggataacagttagaaatgactgctaataccgcataacccgataggatcgcatgatccagacggaaaagatttatcggtgtgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtcaagcaagtcagaagtgaaaggctggggctcaaccccgggactgcttttgaaactgtttgactggagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgtcggggagcacagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcccgatgaccgttccgtaatgggaacttctcttcggagcatcggtgacaggtggtgcatggttgtcgtcagctcgtgtcgtgagatgttgggttaagtcccgcaacgagcgcaacccttaccttcagtagccagcagttcggctgggcactctggagggactgccagggataacctggaggaaggtggggatgacgtcaaatcatcatgccccttatgatttgggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccgtaaggaaggagctgccgaaggcgggactgataactggggtgaagtcgtaacaaggtagccgtatcggaaggtgcggctggatcacctcctttctaaggaa

SEQ ID NO: 2727 - DNA, 1540 bp, Clostridiaceae bacterium AF29-16BH
  ref <308>: DATABASE ACCESSION NUMBER: NCBI ACCESSION: NZ_QUFF01000006.1
  ref <309>: DATABASE ENTRY DATE: 2019-04-01
  ref <313>: RELEVANT RESIDUES IN SEQ ID NO: (1)..(1540)
tttaatcgagagtttgatcctggctcaggatgaacgctggcggcgtgcttaacacatgcaagtcgaacgaagcacttaagattgattcttcggatgatttcttttgtgacttagtggcggacgggtgagtaacgcgtgggtaacctgcctcacacagggggataacagttagaaatgactgctaataccgcataacccgataggatcgcatgatccagacggaaaagatttatcggtgtgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtcaagcaagtcagaagtgaaaggctggggctcaaccccgggactgcttttgaaactgtttgactggagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgtcggggagcacagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcccgatgaccgttccgtaatggggacttcccttcggggcatcggtgacaggtggtgcatggttgtcgtcagctcgtgtcgtgagatgttgggttaagtcccgcaacgagcgcaacccttaccttcagtagccagcagttcggctgggcactctggagggactgccagggataacctggaggaaggtggggatgacgtcaaatcatcatgccccttatgatttgggctacacacgtgctacaatggcgtaaacaaagggaagcaagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccgtaaggaaggagctgccgaaggcgggactgataactggggtgaagtcgtaacaaggtagccgtatcggaaggtgcggctggatcacctcctttctaaggaa

SEQ ID NO: 2728 - DNA, 1531 bp, Clostridiaceae bacterium AF42-6
  ref <308>: DATABASE ACCESSION NUMBER: NCBI ACCESSION: NZ_QUDN01000082.1
  ref <309>: DATABASE ENTRY DATE: 2019-04-01
  ref <313>: RELEVANT RESIDUES IN SEQ ID NO: (1)..(1531)
tttaatcgagagtttgatcctggctcaggatgaacgctggcggcgtgcttaacacatgcaagtcgaacgaagcacttaagattgattcttcggatgatttcttttgtgacttagtggcggacgggtgagtaacgcgtgggtaacctgcctcacacagggggataacagttagaaatgactgctaataccgcataacccgataggatcgcatgatccagacggaaaagatttatcggtgtgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtcaagcaagtcagaagtgaaaggctggggctcaaccccgggactgcttttgaaactgtttgactggagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgtcggggagcacagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcccgatgaccgttccgtaatggggacttcccttcggggcatcggtgacaggtggtgcatggttgtcgtcagctcgtgtcgtgagatgttgggttaagtcccgcaacgagcgcaacccttaccttcagtagccagcagttcggctgggcactctggagggactgccagggataacctggaggaaggtggggatgacgtcaaatcatcatgccccttatgatttgggctacacacgtgctacaatggcgtaaacaaagggaagcaagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccgtaaggaaggagctgccgaaggcgggactgataactggggtgaagtcgtaacaaggtagccgtatcggaaggtgcggctggatcacctcctt

SEQ ID NO: 2729 - DNA, 1187 bp, Clostridiaceae bacterium AM27-36LB
  ref <308>: DATABASE ACCESSION NUMBER: NCBI ACCESSION: NZ_QUJQ01000003.1
  ref <309>: DATABASE ENTRY DATE: 2019-04-01
  ref <313>: RELEVANT RESIDUES IN SEQ ID NO: (1)..(1187)
tttaatcgagagtttgatcctggctcaggatgaacgctggcggcgtgcttaacacatgcaagtcgaacgaagcacttaagattgattcttcggatgacgtcttttgtgacttagtggcggacgggtgagtaacgcgtgggtaacctgcctcacacagggggataacagttagaaatgactgctaataccgcataacccgataggatcgcatgatccagacggaaaagatttatcggtgtgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtcaagcaagtcagaagtgaaaggctggggctcaaccccgggactgcttttgaaactgtttgactggagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgtcggggagcacagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcccgatgaccgttccgtaatggggacttctcttcggagcatcggtgacaggtggtgcatggttgtcgtcagctcgtgtcgtgagatgttgggttaagtcccgcaacgagcgcaacccttaccttcagtagccagcagttcggctgggcactctggagggactgccagggataacctggaggaaggtggggatgacgtcaa

SEQ ID NO: 2730 - DNA, 1539 bp, Clostridiaceae bacterium DSM 106076
  ref <308>: DATABASE ACCESSION NUMBER: NCBI ACCESSION: NZ_RHJS01000002.1
  ref <309>: DATABASE ENTRY DATE: 2019-04-01
  ref <313>: RELEVANT RESIDUES IN SEQ ID NO: (1)..(1539)
taacgagagtttgatcctggctcaggatgaacgctggcggcgtgcttaacacatgcaagtcgagcgaagcacttttttagaactcttcggagggaagagagggtgacttagcggcggacgggtgagtaacgcgtgggcaacctgccttacacagggggataacaattagaaatgattgctaataccgcataagaccccagtaccgcatggtacagaggtaaaaactgaggtggtgtaagatgggcccgcgtctgattaggtagttggtggggtagaagcctaccaagccgacgatcagtagccgacctgagagggcgaccggccacattgggactgagacacggcccaaactcctacgggaggcagcagtggggaatattgcacaatgggggaaaccctgatgcagcgacgccgcgtgagtgaggaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggataagcaagtctgatgtgaaaatccggggcccaaccccggaattgcattggaaactgcatatctagagtgtcggagaggcaagtggaattcctggtgtagcggtgaaatgcgtagatatcaggaggaacaccagtggcgaaggcggcttgctggacgatgactgacgttgaggctcgaaagcgtggggagcaaacaggattagataccctggtagtccacgccgtaaacgatgactactaggtgtcgggaggcaaagcctttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggccttgacatcccggtgacagcgaagtaatgttcgttttccttcgggacactggagacaggtggtgcatggttgtcgtcagctcgtgtcgtgagatgttgggttaagtcccgcaacgagcgcaacccttaccttcagtagccagcatattagatgggcactctggagggactgccagggacaacctggaggaaggtggggatgacgtcaaatcatcatgccccttatggccagggctacacacgtgctacaatggcgtaaacaaagagaagcgaccacgcgagtgtgagcgaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagccggtgacccaacctaaccaggagggagccgtcgaaggcgggacggatgactggggtgaagtcgtaacaaggtagccgtatcggaaggtgcggctggatcacctcctttctaaggaa

SEQ ID NO: 2731 - DNA, 1502 bp, Clostridiaceae bacterium JG1575
  ref <308>: DATABASE ACCESSION NUMBER: NCBI ACCESSION: NZ_LQGW01000037.1
  ref <309>: DATABASE ENTRY DATE: 2019-04-01
  ref <313>: RELEVANT RESIDUES IN SEQ ID NO: (1)..(1502)
aacatgagagtttgatcctggctcaggacgaacgctggcggcgtgcctaacacatgcaagtcgagcgaggtgtatacacctagcggcggacgggtgagtaacacgtgggtaacctacctcagagaggggaatagccttccgaaaggaagattaataccgcataaaatgtacatttagcattatgagtacatcaaaggagaaatccgctttgagatgggcccgcggcgcattagctagttggagaggtaacggctcaccaaggcgacgatgcgtagccgacctgagagggtgatcggccacattggaactgagacacggtccagactcctacgggaggcagcagtggggaatattgcacaatgggggaaaccctgatgcagcaacgccgcgtgaatgatgacggccttcgggttgtaaagttctttgattggggacgataatgacggtacccaaaaaacaagccacggctaactacgtgccagcagccgcggtaatacgtaggtggcgagcgttgtccggatttactgggcgtaaaggatgcgtaggtggacacttaagtgggatgtgaaatccccgggctcaacccgggaactgcattccaaactgggtgacttgagtgcaggagaggaaagcggaattcctagtgtagcggtgaaatgcgtagatattaggaagaacaccagtggcgaaggcggctttctggactgtaactgacactgaggcatgaaagcgtggggagcaaacaggattagataccctggtagtccacgccgtaaacgatgggtactaggtgttgggggtatcaactcccccagtgccgtcgtaaacacagtaagtaccccgcctggggagtacggtcgcaagattaaaactcaaaggaattgacgggggcccgcacaagcagcggagcatgtggtttaattcgaggcaacgcgaagaaccttacctagacttgacatctcctgaattactcttaatcgaggaagcccttcggggcaggaagacaggtggtgcatggttgtcgtcagctcgtgtcgtgagatgttgggttaagtcccgcaacgagcgcaacccctattgtcagttgctaccattaagttgagcactctggcaagactgcccgggttaaccgggaggaaggtggggatgatgtcaaatcatcatgccccttacgtctagggctacacacgtgctacaatggcaggtacaaagagtcgcgaacccgcgaggggaagctaatctcataaaacctgccccagttcagattgcaggctgcaactcgcctgcatgaagtcggagttgctagtaatcgcgaatcagcatgtcgcggtgaatacgttcccgggccttgtacacaccgcccgtcacaccatgagagttggcaatacccgaagtccgtgagttaacgcaagagacagcggccgaaggtagggtcagcgattggggtgaagtcgtaacaaggtagccgtaggagaacctgcggctggatcacctcctttcta

SEQ ID NO: 2732 - DNA, 1537 bp, Clostridiaceae bacterium MS3
  ref <308>: DATABASE ACCESSION NUMBER: NCBI ACCESSION: NZ_CCYG01000338.1
  ref <309>: DATABASE ENTRY DATE: 2019-04-01
  ref <313>: RELEVANT RESIDUES IN SEQ ID NO: (1)..(1537)
ttaaacaagagagtttgatcctggctcaggatgaacgctggcggcgtgcctaacacatgcaagtcgaacgaagttacacagaggaagttttcggatggaatcggtataacttagtggcggacgggtgagtaacgcgtgggaaacctgccctgtaccgggggataacacttagaaataggtgctaataccgcataagcgcacggaaccgcatggttccgtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccttgggattgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgaatatctcgtaaaagagataggccttcgggacaggggagacaggtggtgcatggttgtcgtcagctcgtgtcgtgagatgttgggttaagtcccgcaacgagcgcaacccttattcttagtagccagcaggtaaagctgggcactctaaggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctcctttcta

SEQ ID NO: 2733 - DNA, 1440 bp, Clostridiaceae bacterium OF09-1
  ref <308>: DATABASE ACCESSION NUMBER: NCBI ACCESSION: NZ_QUMI01000015.1
  ref <309>: DATABASE ENTRY DATE: 2019-04-01
  ref <313>: RELEVANT RESIDUES IN SEQ ID NO: (1)..(1440)
tttaatcgagagtttgatcctggctcaggatgaacgctggcggcgtgcttaacacatgcaagtcgaacgaagcacttgaagatgattcttcggatgaaacttcttgtgacttagtggcggacgggtgagtaacgcgtgggtaacctgcctcacacagggggataacagttagaaatgactgctaataccgcataacccgataggatcgcatgatccagacggaaaagatttatcggtgtgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtcaagcaagtcagaagtgaaaggctggggctcaaccccgggactgcttttgaaactgtttgactggagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgtcggggagcacagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatcccgatgaccgttccgtaatgggaacttctcttcggagcatcggtgacaggtggtgcatggttgtcgtcagctcgtgtcgtgagatgttgggttaagtcccgcaacgagcgcaacccttaccttcagtagccagcagttcggctgggcactctggagggactgccagggataacctggaggaaggtggggatgacgtcaaatcatcatgccccttatgatttgggctacacacgtgctacaatggcgtaaacaaagggaagcaagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacctaaccg

SEQ ID NO: 2734 - DNA, 1542 bp, Clostridiaceae bacterium OM02-2AC
  ref <308>: DATABASE ACCESSION NUMBER: NCBI ACCESSION: NZ_QULU01000016.1
  ref <309>: DATABASE ENTRY DATE: 2019-04-01
  ref <313>: RELEVANT RESIDUES IN SEQ ID NO: (1)..(1542)
caaatggagagtttgatcctggctcaggatgaacgctggcggcatgcctaatacatgcaagtcgaacgaagtctctaggaagcttgcttccaaagagacttagtggcgaacgggtgagtaacacgtaggtaacctgcccatgtgtctgggataactgctggaaacggtagctaaaaccggataggtatacggagcgcatgctctgtatattaaagcgcccctcaaggcgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatgggggaaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtatgctagagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatacaaagactctagagatagagggataattatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaaggagcgaatctcataaaggtcgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgcaaggagtgagccgtcgaaggtaggaccgatgactggggttaagtcgtaacaaggtatccctacgggaacgtggggatggatcacctcctttct

SEQ ID NO: 2735 - DNA, 1540 bp, Clostridiaceae bacterium OM08-6BH
  ref <308>: DATABASE ACCESSION NUMBER: NCBI ACCESSION: NZ_QUKV01000008.1
  ref <309>: DATABASE ENTRY DATE: 2019-04-01
  ref <313>: RELEVANT RESIDUES IN SEQ ID NO: (1)..(1540)
tttaatcgagagtttgatcctggctcaggatgaacgctggcggcgtgcttaacacatgcaagtcgaacgaagcgcttgagattgattcttcggaagatttctcttgtgacttagtggcggacgggtgagtaacgcgtgggtaacctgcctcacacagggggataacagttggaaacgaccgctaataccgcataacccgctagggccgcatggcccggacggaaaagatttatcggtgtgagatggacccgcgttggattagctagttggcagggtaacggcctaccaaggcgacgatccatagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctaagcaagtcagaagtgaaaggctggggctcaaccccgggactgcttttgaaactgtttggctagagtgctggagaggtaagcggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgaatactaggtgtcggggagcacagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccgatgaccggtctgtaatgggaccttctcttcggagcatcggtgacaggtggtgcatggttgtcgtcagctcgtgtcgtgagatgttgggttaagtcccgcaacgagcgcaacccttatcttcagtagccagcgattcggtcgggcactctggagagactgccagggataacctggaggaaggtggggatgacgtcaaatcatcatgccccttatgacttgggctacacacgtgctacaatggcgtaaacaaagggaagcgagagtgtgagcttaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 2736 - DNA, 1540 bp, Clostridiales bacterium 1 7 47FAA
  ref <308>: DATABASE ACCESSION NUMBER: NCBI ACCESSION: NZ_DS990270.1
  ref <309>: DATABASE ENTRY DATE: 2019-04-01
  ref <313>: RELEVANT RESIDUES IN SEQ ID NO: (1)..(1540)
tttaatttgagagtttgatcctggctcaggatgaacgctggcggcgtgcctaacacatgcaagtcgaacgaagcatcttataggaagttttcggatggaatatgggatgactgagtggcggacgggtgagtaacgcgtggataacctgcctcacactgggggataacagttagaaatggctgctaataccgcataagcgcacagtaccgcatggtacggtgtgaaaaacccaggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctgaagtgaaagcccggggctcaaccccgggactgctttggaaactgtgtggctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatgctaggtgtcggggggcaaagcccctcggtgccgccgctaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggacagtaacgtgtcccttccttcgggacaggggagacaggtggtgcatggttgtcgtcagctcgtgtcgtgagatgttgggttaagtcccgcaacgagcgcaacccttatccttagtagccagcatttcgggtgggcactctagggagactgccagggataacctggaggaaggtggggatgacgtcaaatcatcatgccccttatgatttgggctacacacgtgctacaatggcgtaaacaaagggaagcaccctgcgaaggtgagcaaatcccaaaaataacgtcccagttcggactgtagtctgcaacccgactacacgaagctggaatcgctagtaatcgcggatcagaatgccgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaa

SEQ ID NO: 2737 - DNA, 1537 bp, Clostridiales bacterium 70B-A
  ref <308>: DATABASE ACCESSION NUMBER: NCBI ACCESSION: NZ_LR130778.1
  ref <309>: DATABASE ENTRY DATE: 2019-04-01
  ref <313>: RELEVANT RESIDUES IN SEQ ID NO: (1)..(1537)
ttaaacatgagagtttgatcctggctcaggatgaacgctggcggcgtgcctaacacatgcaagtcgagcgagaaggtagagcgtgattcttcggaagagcgatttaccgggcagcggcggacgggtgagtaacgcgtgggtaacctgccttatactgggggataacattctgaaaaggatgctaataccgcataagcgcacagcatcgcatgatgccgtgtgaaaaactccggtggtataagatggacccgcgtctgattagctagttggtgagataatagctcaccaaggcaacgatcagtagccgacctgagagggtgatcggccacattgggactgagacacggcccaaactcctacgggaggcagcagtggggaatattgcacaatgggggaaaccctgatgcagcgacgccgcgtgaaggatgaaggttttcggatcgtaaacttctatcagcagggaagaaaatgactgtacctgactaagaagccccggctaactacgtgccagcagccgcggtaatacgtagggggcaagcgttatccggaattactgggtgtaaagggtgcgtaggcggtaaagtaagttaggtgtgaaagcccggggctcaacctcgggactgcacttaaaactgctttactagaatacaggagaggtaagtggaattctagtgtagcggtgaaatgcgtagatattaggaggaacaccagtggcgaaggcgacttactggactgtgattgacgctgaggcacgaaagcgtggggagcgaacaggattagataccctggtagtccacgccgtaaacgatgaatgctaggtgtcgggggtcgaacctcggtgccgcagctaacgcattaagcattccacctggggagtacgatcgcaagattgaaactcaaaggaattgacgggggcccgcacaagcggtggagcatgtggtttaattcgaagcaacgcgaagaaccttaccaggtcttgacatccctttgaccgaaccttaaccggttctttccttcgggacaaaggtgacaggtggtgcatggttgtcgtcagctcgtgtcgtgagatgttgggttaagtcccgcaacgagcgcaacccttatctttagtagccagcacgttatggtggggactctagagagactgccgaggataactcggaggaaggtggggatgacgtcaaatcatcatgccccttatgatctgggctacacacgtgctacaatggtggtaacaaagggaagcgaagccgcgaggtggagcaaaccccataaaagccatcccagttcggattgtagtctgcaactcgactacatgaagttggaatcgctagtaatcgcgaatcagaatgtcgcggtgaatacgttcccgggccttgtacacaccgcccgtcacaccacgggagtcggaagcacccaacgtcagtgacccaaccgcaaggagggagctgcctaaggtgaaatcgatgactggggtgaagtcgtaacaaggtagccgtatcggaaggtgcggctggatcacctcctttctaaggaa

SEQ ID NO: 2738 - DNA, 1248 bp, Clostridiales bacterium AF36-10
  ref <308>: DATABASE ACCESSION NUMBER: NCBI ACCESSION: NZ_QTLT01000073.1
  ref <309>: DATABASE ENTRY DATE: 2019-04-01
  ref <313>: RELEVANT RESIDUES IN SEQ ID NO: (1)..(1248)
acgatcagtagccgacctgagagggtgaccggccacattgggactgagacacggcccagactcctacgggaggcagcagtgggggatattgcacaatggaggaaactctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgacgcaagtctgaagtgaaatacccgggctcaacctgggaactgctttggaaactgtgttgctagagtgctggagaggtaagcggaattcctagtgtagcggtgaaatgcgtagatattaggaagaacaccagtggcgaaggcggcttactggacagtaactgacgttgaggctcgaaagcgtggggagcaaacaggattagataccctggtagtccacgccgtaaacgatgaatactaggtgttggtgagcaaagctcatcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaaatcttgacatccctctgaaacactcttaatcgagtgcctccttcgggacagaggagacaggtggtgcatggttgtcgtcagctcgtgtcgtgagatgttgggttaagtcccgcaacgagcgcaacccctattgtcagtagccagcaggtaaagctgggcactctgatgagactgccagggataacctggaggaaggtggggatgacgtcaaatcatcatgccccttatgatttgggctacacacgtgctacaatggcgtaaacaaagagaagcgagcctgcgagggggagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcggaaatgcccgaagccagtgacccaagcgaaagcagggagctgtcgaaggcaggtctgataactggggtgaagtcgtaacaaggtagccgtatcggaaggtgcggctggatcacctcctttctaaggaa

SEQ ID NO: 2739 - DNA, 1554 bp, Clostridiales bacterium AM23-16LB
  ref <308>: DATABASE ACCESSION NUMBER: NCBI ACCESSION: NZ_QWVV01000037.1
  ref <309>: DATABASE ENTRY DATE: 2019-04-01
  ref <313>: RELEVANT RESIDUES IN SEQ ID NO: (1)..(1554)
tttattggagagtttgatcctggctcaggatgaacgctggcggcgtgcctaatacatgcaagtcgagcgaatggattaagagcttgctcttatgaagttagcggcggacgggtgagtaacacgtgggtaacctgcccataagactgggataactccgggaaaccggggctaataccggataacattttgaaccgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggacagatgattggggtgaagtcgtaacaaggtagccgtatcggaaggtgcggctggatcacctcctttct

SEQ ID NO: 2740 - DNA, 1530 bp, Clostridiales bacterium Marseille-P2846
  ref <308>: DATABASE ACCESSION NUMBER: NCBI ACCESSION: NZ_LT963430.1
  ref <309>: DATABASE ENTRY DATE: 2019-04-01
  ref <313>: RELEVANT RESIDUES IN SEQ ID NO: (1)..(1530)
aacacaagagtttgatcctggctcaggacgaacgctggcggcgtgcctaacacatgcaagtcgagcggggatcaaggaagagcttgctcggaaatgattctagcggcggacgggtgagtaacgcgtgagcaacctgcctttcacagggggataacgcatcgaaagatgcgctaataccgcatgagaccacagtgccacatggcataggggtcaaaggagcaatccggtgagagatgggctcgcgtctgattagctagttggtgaggtaacggcccaccaaggcgacgatcagtagccgacctgagagggtgatcggccacattggaactgagagacggtccaaactcctacgggaggcagcagtggggaatattgggcaatggggggaaccctgacccagcaacgccgcgtgagggaagaaggctttcgggtcgtaaacctttgtcctatgggacgaagcaagtgacggtaccataggaggaagccccggctaactacgtgccagcaaacgcggtaatacgtagggggcgagcgttgtccggaatgattgggcgtaaagggcgcgtaggcggcctggtaagtctgaagtgaaagtcccgctttcaaggtgggaattgctttggatactgctgggcttgagtgcaggagaggaaagcggaattcccggtgtagcggtgaaatgcgtagagatcgggaggaacaccagtggcgaaggcggctttctggactgtaactgacgctgaggcgcgaaagcgtggggagcaaacaggattagataccctggtagtccacgctgtaaacgatgaatgctaggtgtaggaggtatcgaccccttctgtgccggagtaaacacaataagcattccgcctggggagtacggccgcaaggttgaaactcaaaggaattgacgggggcccgcacaagcagcggagcatgtggtttaattcgaagcaacgcgaagaaccttaccaggtcttgacatccaggtaaagccgtagagatacggtgtgagcttgctcaatctgagacaggtggtgcatggttgtcgtcagctcgtgtcgtgagatgttgggttaagtcccgcaacgagcgcaacccttgtttccagttactaacgcgtagaggcgaggactctggagagaccgccggggacaactcggaggaaggtggggacgacgtcaaatcatcatgccccttatgacctgggctacacacgtgctacaatggccactacaaagaggagcgaaaccgtaaggtagagcgaatctcataaaagtggtcccagttcagattgtgggctgcaacccgcccacatgaagtcggagttgctagtaatcgcggatcagcatgccgcggtgaatacgttcccgggccttgtacacaccgcccgtcacaccatgggagttgggagcacccgaagcgggtgagataaccgaaaggggtcagccttcgaaggtgagaccaatgactggggtgaagtcgtaacaaggtagccgtatcggaaggtgcggctggatcacctcctttcta

SEQ ID NO: 2741 - DNA, 1531 bp, Clostridiales bacterium SIT11
  ref <308>: DATABASE ACCESSION NUMBER: NCBI ACCESSION: NZ_CYUK01000002.1
  ref <309>: DATABASE ENTRY DATE: 2019-04-01
  ref <313>: RELEVANT RESIDUES IN SEQ ID NO: (1)..(1531)
tttaatcgagagtttgatcctggctcaggacgaacgctggcggcgcgcctaacacatgcaagtcgagcgatgaaatttcaacagaactcttcggagtgacgatgaaatggattagcggcggacgggtgagtaacacgtgagaaacctgcctttcacaaggggatagcctcgggaaaccgggattaataccctatgacacacttccttcgcatggaggagatgttaaaactctggtggtgaaagatggtctcgcgtctgattagctagttggtgaggtaacggcccaccaaggccatgatcagtaaccggcctgagagggtgaacggtcacattggaactgagacacggtccaaactcctacgggaggcagcagtggggaatattgcacaatgggggaaaccctgatgcagcgacgccgcgtgagcgatgaaggctttcgagtcgtaaagctctgtcctatgggaagataatgacggtaccataggaggaagccccggctaactacgtgccagcagccgcggtaatacgtagggggcgagcgttgtccggaatcactgggcgtaaagggttcgcaggcggtttatcaagtccgatgtgaaaggcatgggctcaacccatgtaagcattggaaactggtagacttgagttaaggagaggtaagtggaattcctagtgtagcggtgaaatgcgtagatattaggaagaataccggtggcgaaggcgacttactggacttaaactgacgctgaggaacgaaagcgtggggagcaaacaggattagataccctggtagtccacgctgtaaacgatgagtgctaggtgtcggggttactcggtgccgcagttaacacattaagcactccgcctggggagtacgtgcgcaagcatgaaactcaaaggaattgacggggacccgcacaagcagcggagcatgtggtttaattcgaagcaacgcgaagaaccttaccaaggctagacattttactgcccggtctagagatagaccctttcttcggaacagtaaaacaggtggtgcatggttgtcgtcagctcgtgtcgtgagatgttgggttaagtcccgcaacgagcgcaacccttacctttagttgccagcattacggatgggaactctaaagggactgccgatgataaatcggaggaaggtggggatgacgtcaaatcatcatgccctttatgccttgggctacacacgtgctacaatggtcggtacagagagcagcaagcgagcgatctcaagcgaatctcaaaaagccgatctcagttcggattgtaggctgcaactcgcctacatgaagtcggagttgctagtaatcgcgaatcagaatgtcgcggtgaatgcgttcccgggtcttgtacacaccgcccgtcacaccatgggagttggtaatacccgaagccgccgagctaaccatttggaggcaggcgtcgaaggtaggatcaatgactggggtgaagtcgtaacaaggtagccgtatcggaaggtgcggctggatcacctcctttctaagga

SEQ ID NO: 2742 - DNA, 1542 bp, Clostridiales bacterium SYSU GA17129
  ref <308>: DATABASE ACCESSION NUMBER: NCBI ACCESSION: NZ_RXHQ01000076.1
  ref <309>: DATABASE ENTRY DATE: 2019-04-01
  ref <313>: RELEVANT RESIDUES IN SEQ ID NO: (1)..(1542)
tttaaattgagagtttgatcctggctcaggacgaacgctggcggcgtgcctaacacatgcaagtcgagcgaggtttaaggagttagcttgctaacaccttaaacctagcggcggacgggtgagtaacgcgtgagcaacctgccttgtacagggggataacaggtggaaacacttgctaataccgcataaggccacagtatcgcatgatacaggggtcaaaggagtaatccggtacaagatgggctcgcgtcccattagctagttggtgagataaaagcccaccaaggcaacgatgggtagccgacctgagagggtgaccggccacactgggactgagacacggcccagactcctacgggaggcagcagtggggaatattgcgcaatggggggaaccctgacgcagcgacgccgcgtgagcgaagaaggtcttcggatcgtaaagctctgtctttggggacgaaggaagtgacggtacccaaggaggaagccccggctaactacgtgccagcagccgcggtaatacgtagggggcgagcgttgtccggaattactgggcgtaaagggtgcgtaggcggccatataagtcaggtgtgaaaaaccacggcttaaccgaggtattgcacatgaaactgtatggcttgagtacaggagaggaaagtggaattcctagtgtagcggtgaaatgcgtagagattaggaagaacaccagtggcgaaggcggctttctggactgtaactgacgctgaggcacgaaagcgtggggagcaaacaggattagataccctggtagtccacgctgtaaacgatggatactaggtgtaggggtttaaagacttctgtgccggagttaacgcaataagtatcccgcctggggagtacggccgcaaggctgaaactcaaaggaattgacgggggcccgcacaagcagcggagcatgtggtttaattcgaagcaacgcgaagaaccttaccaaggcttgacatccctctgaagtatttagagataagtacggactcttcggagtacagaggagacaggtggtgcatggttgtcgtcagctcgtgtcgtgagatgttgggttaagtcccgcaacgagcgcaacccttatctttagttgccagcacttagggtgggcactctagagagactgccggggataactcggaggaaggtggggatgacgtcaaatcatcatgccccttatgtcttgggctacacacgtgctacaatggtctgaaacagagggaagcgaaggcgcaagctggagcaaatcccacaaaccaggccacagttcggattgtgggctgcaacccgcccacatgaagccggagttgctagtaatcgcgaatcagcatgtcgcggtgaatgcgttcccgggccttgtacacaccgcccgtcacaccatggaagttgggagcacccgaagccggtgacctaaccgtaagggaggagccgtcgaaggtgagcttaatgactggggtgaagtcgtaacaaggtagccgtatcggaaggtgcggctggatcacctcctttctaagga

SEQ ID NO: 2743 - DNA, 1345 bp, Clostridiales bacterium VE202-06
  ref <308>: DATABASE ACCESSION NUMBER: NCBI ACCESSION: NZ_BAHT02000283.1
  ref <309>: DATABASE ENTRY DATE: 2019-04-01
  ref <313>: RELEVANT RESIDUES IN SEQ ID NO: (1)..(1345)
cgcacaggaccgcatggtctggtgtgaaaaactccggtggtatgagatggacccgcgtctgattagctagttggaggggtaacggcccaccaaggcgacgatcagtagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggaagagcaagtctgatgtgaaaggctggggcttaaccccaggactgcattggaaactgttgttctagagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgccgtaaacgatgaatactaggtgtcgggtggcaaagccattcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgaccgtcccgtaatgggggcttcccttcggggcagaggagacaggtggtgcatggttgtcgtcagctcgtgtcgtgagatgttgggttaagtcccgcaacgagcgcaacccttatccttagtagccagcacatgatggtgggcactctagggagactgccggggataacccggaggaaggcggggacgacgtcaaatcatcatgccccttatgatttgggctacacacgtgctacaatggcgtaaacaaagggaagcgagacagcgatgttgagcgaatcccaaaaataacgtcccagttcggactgcagtctgcaactcgactgcacgaagctggaatcgctagtaatcgcggatcagaatgccgcggtgaatacgttcccgggtcttgtacacaccgcccgtcacaccatgggagtcagtaacgcccgaagtcagtgacctaaccgaaaggaaggagctgccgaaggcgggaccgataactggggtgaagtcgtaacaaggtagccgtatcggaaggtgcggctggatcacctcctttctaaggaa

SEQ ID NO: 2744 - DNA, 1544 bp, Clostridiales bacterium VE202-07
  ref <308>: DATABASE ACCESSION NUMBER: NCBI ACCESSION: NZ_BAHU02000044.1
  ref <309>: DATABASE ENTRY DATE: 2019-04-01
  ref <313>: RELEVANT RESIDUES IN SEQ ID NO: (1)..(1544)
ttaaacatgagagtttgatcctggctcaggatgaacgctggcggcgtgcctaacacatgcaagtcgaacgaagcaattaaaatgaagttttcggatggatttttgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctcctttctaaggaa

SEQ ID NO: 2745 - DNA, 1543 bp, Clostridiales bacterium VE202-09
  ref <308>: DATABASE ACCESSION NUMBER: NCBI ACCESSION: NZ_BAHW02000064.1
  ref <309>: DATABASE ENTRY DATE: 2019-04-01
  ref <313>: RELEVANT RESIDUES IN SEQ ID NO: (1)..(1543)
gaacatgagagtttgatcctggctcaggatgaacgctggcggcgtgcttaacacatgcaagtcgaacgaagcattttggaaggaagttttcggatggaattccttaatgactgagtggcggacgggtgagtaacgcgtggggaacctgccctatacagggggataacagctggaaacggctgctaataccgcataagcgcacagaatcgcatgattcggtgtgaaaagctccggcagtataggatggtcccgcgtctgattagctggttggcggggtaacggcccaccaaggcgacgatcagtagccggcttgagagagtggacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaagacggtacctgactaagaagccccggctaactacgtgccagcagccgcggtaatacgtagggggcaagcgttatccggaattactgggtgtaaagggtgcgtaggtggcatggtaagtcagaagtgaaagcccggggcttaaccccgggactgcttttgaaactgtcatgctggagtgcaggagaggtaagcggaattcctagtgtagcggtgaaatgcgtagatattaggaggaacaccagtggcgaaggcggcttactggactgtcactgacactgatgcacgaaagcgtggggagcaaacaggattagataccctggtagtccacgccgtaaacgatgaatactaggtgtcggggccgtagaggcttcggtgccgcagcaaacgcagtaagtattccacctggggagtacgttcgcaagaatgaaactcaaaggaattgacggggacccgcacaagcggtggagcatgtggtttaattcgaagcaacgcgaagaaccttacctggtcttgacatctaactgaccggttcgtaatgggacctttccttcgggacagttaagacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatggccagggctacacacgtgctacaatggcgtaaacaaagggaagcgaagtcgtgaggcgaagcaaatcccagaaataacgtctcagttcggattgtagtctgcaactcgactacatgaagctggaatcgctagtaatcgtgaatcagaatgtcacggtgaatacgttcccgggtcttgtacacaccgcccgtcacaccatgggagtcagtaacgcccgaagtcagtgacccaaccttataggagggagctgccgaaggtgggaccgataactggggtgaagtcgtaacaaggtagccgtatcggaaggtgcggctggatcacctcctttctaaggaa

SEQ ID NO: 2746 - DNA, 1541 bp, Clostridiales bacterium VE202-15
  ref <308>: DATABASE ACCESSION NUMBER: NCBI ACCESSION: NZ_BAIC02000310.1
  ref <309>: DATABASE ENTRY DATE: 2019-04-01
  ref <313>: RELEVANT RESIDUES IN SEQ ID NO: (1)..(1541)
ttttaatttgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgcctttccttcgggacaagagagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaa

SEQ ID NO: 2747 - DNA, 1541 bp, Clostridiales bacterium VE202-16; identical to SEQ ID NO: 465
  ref <308>: DATABASE ACCESSION NUMBER: NCBI ACCESSION: NZ_BAID02000318.1
  ref <309>: DATABASE ENTRY DATE: 2019-04-01
  ref <313>: RELEVANT RESIDUES IN SEQ ID NO: (1)..(1541)

SEQ ID NO: 2748 - DNA, 1440 bp, Clostridiales bacterium VE202-21
  ref <308>: DATABASE ACCESSION NUMBER: NCBI ACCESSION: NZ_BAIF02000133.1
  ref <309>: DATABASE ENTRY DATE: 2019-04-01
  ref <313>: RELEVANT RESIDUES IN SEQ ID NO: (1)..(1440)
tttaacgagagtttgatcctggctcaggatgaacgctggcggcgtgcttaacacatgcaagtcgagcgaagcgctttacttagatttcttcggattgaaaagttttgcgactgagcggcggacgggtgagtaacgcgtgggtaacctgcctcatacagggggataacagttagaaatgactgctaataccgcataagaccacagtaccgcatggtacagtgggaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggttatgtaagtctgatgtgaaaacccggggctcaaccccgggactgcattggaaactatgtaactagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgcatactaggtgtcgggtggcaaagccattcggtgccgcagcaaacgcaataagtatgccacctggggagtacgttcgcaagaatgaaactcaaaggaattgacggggacccgcacaagcggtggagcatgtggtttaattcgaagcaacgcgaagaaccttacctgctcttgacatccccctgaccggcgcgtaatggtgcctttccttcgggacaggggagacaggtggtgcatggttgtcgtcagctcgtgtcgtgagatgttgggttaagtcccgcaacgagcgcaacccttatctttagtagccagcggtttggccgggcactctagagagactgccagggataacctggaggaaggtggggatgacgtcaaatcatcatgccccttatgagcagggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaacc

SEQ ID NO: 2749 - DNA, 1441 bp, Clostridiales bacterium VE202-27
  ref <308>: DATABASE ACCESSION NUMBER: NCBI ACCESSION: NZ_BAIJ02000227.1
  ref <309>: DATABASE ENTRY DATE: 2019-04-01
  ref <313>: RELEVANT RESIDUES IN SEQ ID NO: (1)..(1441)
ttaaacaagagagtttgatcctggctcaggatgaacgctggcggcgtgcctaacacatgcaagtcgaacggagttatgcagaggaagttttcggatggaatcggcgtaacttagtggcggacgggtgagtaacgcgtgggaaacctgcctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatgacaagccagatgtgaaaacccagggctcaaccctgggactgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgtgtccgtaacggggcattctcttcggagcattggagacaggtggtgcatggttgtcgtcagctcgtgtcgtgagatgttgggttaagtcccgcaacgagcgcaacccttatccttagtagccagcaggtaaagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccg

SEQ ID NO: 2750 - DNA, 1533 bp, Clostridiales bacterium mt11
  ref <308>: DATABASE ACCESSION NUMBER: NCBI ACCESSION: NZ_LN874944.1
  ref <309>: DATABASE ENTRY DATE: 2019-04-01
  ref <313>: RELEVANT RESIDUES IN SEQ ID NO: (1)..(1533)
ttttatatgagagtttgatcctggctcaggacgaacgctggcggcgtgcctaacacatgcaagtcgagcgaagtgcttattaggaaatcttcggatggaatgataagtatcttagcggcggatgggtgagtaacgcgtgaggaacctgccttctacaaggggatagcctcgggaaaccgggattaataccctatgatacttcttaatcgcatgattttgaagttaaagcgttagcggtagaagatggtctcgcgtcccattagctagttggtgaggtaacggctcaccaaggctacgatgggtagccggcttgagagagtgaacggccacactggaactgagacacggtccagactcctacgggaggcagcagtggggaatattgcacaatggaggaaactctgatgcagcgacgccgcgtgagcgatgaaggccttcgggtcgtaaagctctgtcctaagggacgataatgacggtaccttaggaggaagccccggctaactacgtgccagcagccgcggtaatacgtagggggcgagcgttgtccggatttactgggcgtaaagggtacgcaggcggtcatgtaagtcagatgtgaaagatcacggcttaaccgtggtaagcatttgaaactgcgtggcttgagttaaggagaggaaagtggaattcctggtgtagcggtgaaatgcgtagatatcaggaggaataccagtggcgaaggcggctttctggacttatactgacgctgaggtacgaaagcgtggggagcaaacaggattagataccctggtagtccacgctgtaaacgatgagtgctaggtgtcgggggtcaaacctcggtgccgcagttaacacattaagcactccgcctggggagtacgttcgcaagaatgaaactcaaaggaattgacggggacccgcacaagcagcggagcatgtggtttaattcgatgcaacgcgaagaaccttaccaggacttgacatccctcggaccgaattagagataattctttcccttcggggactgaggagacaggtggtgcatggttgtcgtcagctcgtgtcgtgagatgttgggttaagtcccgcaacgagcgcaacccttgcctttagttgccaacagttcggctgtgcactctagagggactgccgatgataaatcggaggaaggtggggatgacgtcaaatcatcatgccctttatgtcctgggctacacacgtgctacaatggtcggtacagagggcagcaacttagcgataagaagctaatcccttaaagccgatctcagttcggattgcaggctgcaactcgcctgcatgaagccggagttgctagtaatcgtggatcagaatgccacggtgaatgcgttcccgggtcttgtacacaccgcccgtcacaccatgggagttagcaatgcccgaagccagtgagctaaccgtaaggaggcaactgtcgaaggtagggccaatgactggggtgaagtcgtaacaaggtagccgtatcggaaggtgcggctggatcacctcctttct

SEQ ID NO: 2751 - DNA, 1553 bp, Clostridiales bacterium mt7
  ref <308>: DATABASE ACCESSION NUMBER: NCBI ACCESSION: NZ_FZRH01000015.1
  ref <309>: DATABASE ENTRY DATE: 2019-04-01
  ref <313>: RELEVANT RESIDUES IN SEQ ID NO: (1)..(1553)
tttattggagagtttgatcctggctcaggacgaacgctggcggcgtgcctaatacatgcaagtcgagcggactttaaaagcttgcttttaaagttagcggcggacgggtgagtaacacgtgggcaacctgcctgtaagactgggataacttcgggaaaccggagctaataccggataatccttttcctctcatgaggaaaagctgaaagacggcatctcgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccgcctaaggtgggatagatgattggggtgaagtcgtaacaaggtagccgtatcggaaggtgcggctggatcacctcctttcta

SEQ ID NO: 2752 - DNA, 1508 bp, Clostridiales bacterium oral taxon 876
  ref <308>: DATABASE ACCESSION NUMBER: NCBI ACCESSION: NZ_KE993469.1
  ref <309>: DATABASE ENTRY DATE: 2019-04-01
  ref <313>: RELEVANT RESIDUES IN SEQ ID NO: (1)..(1508)
ttttaaattgagagtttgatcctggctcaggacgaacgctggcggcgtgcctaacacatgcaagtcgagcgggagacttcggtctctagcggcggacgggtgagtaacacgtgggtaacctgccttagtgagggggatagcctcccgaaagggagattaataccgcataacattgcgatatcgcatgatattgtaattaaaggagtaatccgcactaagatggacccgcggcgcattagctagttggtgaggtaacggctcaccaaggcgacgatgcgtagccggcctgagagggtgaacggccacattggaactgagacacggtccagactcctacgggaggcagcagtggggaatattgcacaatgggcgaaagcctgatgcagcaacgccgcgtgagtgatgaaggccttcgggttgtaaagctctgtcttctgggacgataatgacggtaccagaggaggaagccacggctaactacgtgccagcagccgcggtaatacgtaggtggcaagcgttgtccggatttactgggcgtaaaggatgcgtaggcggatacttaagtcagatgtgaaaatcccgggcttaacttgggaactgcatttgaaactgggtatctagagtgcgggagaggaaagtggaattcctagtgtagcggtgaaatgcgtagagattaggaagaacaccagtggcgaaggcgactttctggaccgtaactgacgctgaggcatgaaagcgtggggagcaaacaggattagataccctggtagtccacgccgtaaacgatgaatactaggtgtgggggttatcatgacctccgtgccgcagttaacacaataagtattccgcctggggagtacggtcgcaagattaaaactcaaaggaattgacgggggcccgcacaagcagcggagcatgtggtttaattcgaagcaacgcgaagaaccttacctagacttgacatctcctgaattaccggtaatgcgggaagcccttcggggcaggaagacaggtggtgcatggttgtcgtcagctcgtgtcgtgagatgttgggttaagtcccgcaacgagcgcaacccttgtcgttagttgctaccattaagttgagcactctagcgagactgccgcggttaacgcggaggaaggtggggatgacgtcaaatcatcatgccccttatgtctagggctacacacgtgctacaatggtcggtacaaaaagacgcaaagccgcgaggcggagcaaaactcaaaaaccgatcccagttcggattgtaggctgcaactcgcctacatgaagccggagttgctagtaatcgcaaatcagaatgttgcggtgaatacgttcccgggccttgtacacaccgcccgtcacaccatgagagttgccaacacccgaagtccgtgagctaaccttttggaggcagcggccgaaggtgggggtagcgattggggtgaagtcgtaacaaggtagccgtaggagaacctgcggctggatcacctcctttcta

SEQ ID NO: 2753 - DNA, 458 bp, Clostridiisalibacter paucivorans
  ref <308>: DATABASE ACCESSION NUMBER: NCBI ACCESSION: NZ_JHVL01000044.1
  ref <309>: DATABASE ENTRY DATE: 2019-04-01
  ref <313>: RELEVANT RESIDUES IN SEQ ID NO: (1)..(458)
ttttattttgagagtttgatcctggctcaggacgaacgctggcggcgcgcctaacacatgcaagtcgagcgtgaagctttcaaaagatccttcgggtgaaattaaaagtggaaagcggcggacgggtgagtaacgcgtgggaaacctgccctgtacagggggatagcctcgggaaaccgggattaataccccatgaaaccttagcatcgcatgatgcatgggtcaaaactcaggtggtataggatggtcccgcgtcccattagctagttggtagggtaaaggcctaccaaggcgacgatgggtagccggcctgagagggtgaacggccacactggaactgagacacggtccagactcctacgggaggcagcagtggggaatattgcacaatgggggaaaccctgatgcagcgacgccgcgtgagcgatgaaggctttcgagtcgtaaagctctgtcct

SEQ ID NO: 2754 - DNA, 1647 bp, Clostridium aceticum
  ref <308>: DATABASE ACCESSION NUMBER: NCBI ACCESSION: NZ_CP009687.1
  ref <309>: DATABASE ENTRY DATE: 2019-04-01
  ref <313>: RELEVANT RESIDUES IN SEQ ID NO: (1)..(1647)
ttttttattaagagtttgatcctggctcaggatgaacgctggcggcgtgcctaacacatgcaagtcgagcgaggcaaatatctaacattgagtacttgagagattaagggagaaagagagccagcgttaagcaggcctgtagaccctttgtgagcaaaggctagctttacgccataaagtgccaacacatgatgagaatcgagtattgaatgttagatatttgcctagcggcggacgggtgagtaacgcgtgggtaacctaccttgtacagggggataacagtcggaaacgattgctaataccgcataaagctattctaaggcatcttaagaatagccaaagatttattggtacaagatgggcccgcgtctgattagctagttggtggggtaaaggcctaccaaggcgacgatcagtagccgacctgagagggtgaccggccacactggaactgagacacggtccagactcctacgggaggcagcagtgggggatattgcacaatgggggaaaccctgatgcagcgacgccgcgtgagcgatgaaggccttcgggtcgtaaagctctgtttcgagggaagataatgacggtacctcgggaggaagccccggctaactacgtgccagcagccgcggtaatacgtagggggcaagcgttatccggaatcactgggcgtaaagggtgcgtaggcggccaataaagtctagggtgaaaggctacggctcaaccgtagtaagccttagaaacttattggcttgagtgcaggagaggagagtggaattcctagtgtagcggtgaaatgcgtagatattaggaggaacaccagtggcgaaggcgactctctggactgtaactgacgctgaggcacgaaagcgtggggagcgaacaggattagataccctggtagtccacgccgtaaacgatgagtgctaggtgttgggggtcaaacctcagtgccgcagctaacgcattaagcactccgcctggggagtacgcacgcaagtgtgaaactcaaaggaattgacggggacccgcacaagcagcggagcatgtggtttaattcgaagcaacgcgaagaaccttacctggacttgacatccttttgaccgctttttaacagaagttttcccttcggggacagaagtgacaggtggtgcatggttgtcgtcagctcgtgtcgtgagatgttgggttaagtcccgcaacgagcgcaacccttgtctttagttgccagcatttcggatgggcactctagagagactgccggggataactcggaggaaggtggggatgacgtcaaatcatcatgccccttatgttcagggctacacacgtgctacaatggccgatacaaagggcagcgaaggagtaatctggagcgaatctcataaagtcggtctcagttcggattgtgggctgaaactcgcccacatgaagtcggagttgctagtaatcgcgaatcagaatgtcgcggtgaatgcgttcccgggtcttgtacacaccgcccgtcacaccacgggagtcggaagcgcccgaagccagctgctcaaccgtaaggggagagctgtcgaaggtgaagccgatgactggggtgaagtcgtaacaaggtagccgtatcggaaggtgcggctggatcacctcctttct

SEQ ID NO: 2755 - DNA, 1092 bp, Clostridium acidisoli
  ref <308>: DATABASE ACCESSION NUMBER: NCBI ACCESSION: NZ_FWXH01000062.1
  ref <309>: DATABASE ENTRY DATE: 2019-04-01
  ref <313>: RELEVANT RESIDUES IN SEQ ID NO: (1)..(1092)
ctctgtcttttgggacgataatgacggtaccaaaggaggaagccacggctaactacgtgccagcagccgcggtaatacgtaggtggcaagcgttgtccggaattactgggcgtaaaggatgtgtaggcggatatttaagtgagatgtgaaatccccgagctcaacttgggggctgcatttcaaactgggtatctagagtgcaggagaggaaagcggaattcctagtgtagcggtgaaatgcgtagagattaggaagaacatcagtggcgaaggcggctttctggactgtaactgacgctgaggcatgaaagcgtggggagcaaacaggattagataccctggtagtccacgccgtaaacgatgagtactaggtgtaggaggtatcgactccttctgtgccgcagttaacacaataagtactccgcctgggaagtacggtcgcaagattaaaactcaaaggaattgacgggggcccgcacaagcagcggagcatgtggtttaattcgaagcaacgcgaagaaccttacctagacttgacatcccctgaataacgtagagatacgcgaagcccttcggggcagggagacaggtggtgcatggttgtcgtcagctcgtgtcgtgagatgttgggttaagtcccgcaacgagcgcaacccttatcattagttgctaccatttagttgagcactctagtgagactgcccgggttaaccgggaggaaggcggggatgacgtcaaatcatcatgccccttatgtctagggctacacacgtgctacaatggtgagaacaacgagatgcaataccgcgaggtggagcaaaacttcaaaactcatctcagttcggattgtaggctgaaactcgcctacatgaagttggagttgctagtaatcgcgaatcagaatgtcgcggtgaatacgttcccgggccttgtacacaccgcccgtcacaccatgagagctggtaacacccgaagtccgtgaggtaacctttattggggccagcggccgaaggtgggattagtgattggggtgaagtcgtaacaaggtagccgtaggagaacctgcggctggatcacctcctttctaaggag

SEQ ID NO: 2756 - DNA, 1128 bp, Clostridium akagii
  ref <308>: DATABASE ACCESSION NUMBER: NCBI ACCESSION: NZ_JMLK01000055.1
  ref <309>: DATABASE ENTRY DATE: 2019-04-01
  ref <313>: RELEVANT RESIDUES IN SEQ ID NO: (1)..(1128)
cccgcggcgcattagctagttggagaggtaacggctcaccaaggcaacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaaactctgtctttggggacgataatgacggtacccaaggaggaagccacggctaactacgtgccagcagccgcggtaatacgtaggtggcaagcgttgtccggaattactgggcgtaaaggatgtgtaggcggatatttaagtgagatgtgaaatccccgggcttaacctgggggctgcatttcaaactgggtatctagagtgcaggagaggaaagcggaattcctagtgtagcggtgaaatgcgtagatattaggaagaacatcagtggcgaaggcggctttctggactgtaactgacgctgagacatgaaagcgtggggagcaaacaggattagataccctggtagtccacgccgtaaacgatgagtactaggtgtaggaggtatcgactccttctgtgccgtcgttaacacaataagtactccgcctgggaagtacggtcgcaagattaaaactcaaaggaattgacgggggcccgcacaagcagcggagcatgtggtttaattcgaagcaacgcgaagaaccttacctagacttgacatctcctgaattacctgtaataagggaagcccttcggggcaggaagacaggtggtgcatggttgtcgtcagctcgtgtcgtgagatgttgggttaagtcccgcaacgagcgcaacccttattattagttgctaccattaagttgagcactctagtgagactgcccgggttaaccgggaggaaggcggggatgacgtcaaatcatcatgccccttatgtctagggctacacacgtgctacaatggtgagaacaacgagatgcaataccgcgaggtggagccaaacttcaaatctcatctcagttcggattgtaggctgaaactcgcctacatgaagttggagttgctagtaatcgcgaatcagaatgtcgcggtgaatacgttcccgggc

SEQ ID NO: 2757 - DNA, 736 bp, Clostridium arbusti
  ref <308>: DATABASE ACCESSION NUMBER: NCBI ACCESSION: NZ_BAEV01000203.1
  ref <309>: DATABASE ENTRY DATE: 2019-04-01
  ref <313>: RELEVANT RESIDUES IN SEQ ID NO: (1)..(736)
tggacccgcggcgcattagctagttggagaggtaacggctcaccaaggcaacgatgcgtagccgacctgagagggtgatcggccacattggaactgagacacggtccagactcctacgggaggcagcagtggggaatattgcacaatgggcgaaagcctgatgcagcaacgccgcgtgagtgatgacggtcttcggattgtaaagctctgtcttttgggacgataatgacggtaccaaaggaggaagccacggctaactacgtgccagcagccgcggtaatacgtaggtggcaagcgttgtccggatttactgggcgtaaaggatgtgtaggcggacatttaagtgagatgtgaaagccccgagctcaacttggggactgcatttcaaactgggtgtctagagtgcaggagaggaaagcggaattcctagtgtagcggtgaaatgcgtagagattaggaagaacatcagtggcgaaggcggctttctggactgtaactgacgctgaggcatgaaagcgtggggagcaaacaggattagataccctggtagtccacgccgtaaacgatgagtactaggtgtaggaggtatcgactccttctgtgccgcagttaacacaataagtactccgcctgggaagtacggtcgcaagtattaaaactcaaaggaattgacgggggcccgacacaacgcagcggagcatgtggttttaattcgaagctaacgcgaagaacctta

SEQ ID NO: 2758 - DNA, 1512 bp, Clostridium aurantibutyricum
  ref <308>: DATABASE ACCESSION NUMBER: NCBI ACCESSION: NZ_LZYW01000149.1
  ref <309>: DATABASE ENTRY DATE: 2019-04-01
  ref <313>: RELEVANT RESIDUES IN SEQ ID NO: (1)..(1512)
ttttaaattgagagtttgatcctggctcaggacgaacgctggcggcgtgcttaacacatgcaagtcgagcggggaacttcggttcccagcggcggacgggtgagtaacacgtgggtaacctgcctcatagtggggaatagccttccgaaaggaagattaataccgcataatactcggaaatcacatgatttctgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgataatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaagtcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtagggacaaaaagatgctataccgcaaggtggagctaaactcaaaaccctatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgatgattggggtgaagtcgtaacaaggtagccgtaggagaacctgcggctggatcacctcctttcta

SEQ ID NO: 2759 - DNA, 1524 bp, Clostridium bornimense
  ref <308>: DATABASE ACCESSION NUMBER: NCBI ACCESSION: NZ_HG917868.1
  ref <309>: DATABASE ENTRY DATE: 2019-04-01
  ref <313>: RELEVANT RESIDUES IN SEQ ID NO: (1)..(1524)
ttttaaattgagagtttgatcctggctcaggacgaacgctggcggcgtgcttaacacatgcaagtcgagcgaacaaagctccttcgggagtggagttagcggcggacgggtgagtaacacgtgggtaacctgccttatagagggggatagccttccgaaaggaagattaataccgcataagaagtagaagtcgcatggctttagctttaaaggagcaatccgctataagatggacccgcggcgcattagctagttggtgaggtaacggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgggtgatgaaggttttcggatcgtaaagccctgtcttttgggacgataatgacggtaccaaaggaggaagccacggctaactacgtgccagcagccgcggtaatacgtaggtggcaagcgttgtccggatttactgggcgtaaagggagcgtaggcggacctttaagtgagatgtgaaatacccgagctcaacttgggtgctgcatttcaaactggaggtctagagtgtcggagaggtaagtggaattcctagtgtagcggtgaaatgcgtagagattaggaagaaccccggtggcgaaggcgacttactggacgataactgacgctgaggctcgaaagcgtggggagcaaacaggattagataccctggtagtccacgccgtaaacgatgaatactaggtgtgggggttgtcatgacctccgtgccgtcgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctaccattaagttgagcactctagcaagactgccgtggttaacgcggaggaaggtggggatgacgtcaaatcatcatgccccttatgtctagggctacacacgtgctacaatggtgagtacaaagagacgcaaaaccgtgaggtggagcaaaactcaaaaactcatcccagttcggattgtaggctgcaactcgcctacatgaagttggagttgctagtaatcgcgaatcagaatgtcgcggtgaatacgttcccgggccttgtacacaccgcccgtcacaccatgagagctggtaacacccgaagtccgtgaggtaaccgcaaggagccagcggccgaaggtgggattagtgattggggtgaagtcgtaacaaggtagccgtaggagaacctgcggctggatcacctcctttctaagga

SEQ ID NO: 2760 - DNA, 1518 bp, Clostridium carboxidivorans
  ref <308>: DATABASE ACCESSION NUMBER: NCBI ACCESSION: NZ_CP011803.1
  ref <309>: DATABASE ENTRY DATE: 2019-04-01
  ref <313>: RELEVANT RESIDUES IN SEQ ID NO: (1)..(1518)
ttttaaattgagagtttgatcctggctcaggacgaacgctggcggcgtgcttaacacatgcaagtcgagcgatgaaatcccttcggggatggattagcggcggacgggtgagtaacacgtgggcaacctgcctcaaagtgggggatagccttccgaaagggagattaataccgcataacattagtttttcacatgaattactaattaaaggagtaatccgctttgagatgggcccgcggcgcattagctagttggtgaggtaacggctcaccaaggccacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtctttggggacgataatgacggtacccaaggaggaagccacggctaactacgtgccagcagccgcggtaatacgtaggtggcgagcgttgtccggatttactgggcgtaaaggatgcgtaggcggatgtttaagtcagatgtgaaaatcccgagcttaacttgggaactgcatttgaaactggatatctagagtgcgggagaggagaatggaattcctagtgtagcggtgaaatgcgtagagattaggaagaacaccagtggcgaaggcgattctctggaccgtaactgacgctgaggcatgaaagcgtgggtagcaaacaggattagataccctggtagtccacgccgtaaacgatgaatactaggtgtaggaggtatcgactccttctgtgccgcagctaacgcaataagtattccgcctgggaagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttaggttaagtcctgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgagtacagaaagatgcaagaccgtgaggtggagcaaaacttttaaaactcatctcagttcggattgtaggctgaaactcgcctacatgaagctggagttgctagtaatcgcgaatcagcatgtcgcggtgaatacgttcccgggccttgtacacaccgcccgtcacaccatgagagctggcaacacccgaagtccgtgaggtaaccgtaaggagccagcggccgaaggtggggttagtaattggggtgaagtcgtaacaaggtagccgtaggagaacctgcggctggatcacctcctttcta

SEQ ID NO: 2761 - DNA, 777 bp, Clostridium colicanis
  ref <308>: DATABASE ACCESSION NUMBER: NCBI ACCESSION: NZ_LTBB01000047.1
  ref <309>: DATABASE ENTRY DATE: 2019-04-01
  ref <313>: RELEVANT RESIDUES IN SEQ ID NO: (1)..(777)
ggctaactacgtgccagcagccgcggtaatacgtaggtggcaagcgttgtccggatttactgggcgtaaagagtatgtaggcggatatttaagtcagatgtgaaattcccgggcttaacctgggcgctgcatttgatactggatatctagagtgtgggagaggaaagcggaattcctagtgtagcggtgaaatgcgtagagattaggaagaacaccagtggcgaaggcggctttctggaccataactgacgctgagatacgaaagcgtggggagcaaacaggattagataccctggtagtccacgccgtaaacgatgaatactaggtgtcgggggtattaccaccctcggtgccgcagcaaacgcaataagtattccgcctggggagtacggtcgcaagattaaaactcaaaggaattgacggggacccgcacaagcagcggagcatgtggtttaattcgaagcaacgcgaagaaccttacctagacttgacatctcctgaattactcgtaatggaggaagcccttcggggcaggaagacaggtggtgcatggttgtcgtcagctcgtgtcgtgagatgttgggttaagtcccgcaacgagcgcaacccttatcgttagttgctaccattaagttgagcactctaacgagactgccgcggttaacgtggaggaaggtggggatgacgtcaaatcatcatgccccttatgtctagggctacacacgtgctacaatggccggtacaacgagatgcaaacccgtgagggggagccaaact

SEQ ID NO: 2762 - DNA, 258 bp, Clostridium collagenovorans
  ref <308>: DATABASE ACCESSION NUMBER: NCBI ACCESSION: NZ_FQXP01000002.1
  ref <309>: DATABASE ENTRY DATE: 2019-04-01
  ref <313>: RELEVANT RESIDUES IN SEQ ID NO: (1)..(258)
ggctcaccaaggcaacgatgcgtagccgacctgagagggtgatcggccacattgggactgagacacggcccagactcctacgggaggcagcagtggggaatattgcgcaatgggggaaaccctgacgcagcaacgccgcgtgagtgatgaaggtcttcggattgtaaagctctgtcttatgggaagataatgacggtaccataggaggaagccacggctaactacgtgccagcagccgcggtaatacgtaggtggcaa

SEQ ID NO: 2763 - DNA, 1313 bp, Clostridium coskatii
  ref <308>: DATABASE ACCESSION NUMBER: NCBI ACCESSION: NZ_LROR01000040.1
  ref <309>: DATABASE ENTRY DATE: 2019-04-01
  ref <313>: RELEVANT RESIDUES IN SEQ ID NO: (1)..(1313)
tttaaaggagtaatccgctttgagatggacccgcggcgcattagctagttggtagggtaacggcctaccaaggcgacgatgcgtagccgacctgagagggtgatcggccacattggaactgagagacggtccagactcctacgggaggcagcagtggggaatattgcacaatgggcgaaagcctgatgcagcaacgccgcgtgagtgaagaaggttttcggattgtaaagctctgtctttggggacgataatgacggtacccaaggaggaagccacggctaactacgtgccagcagccgcggtaatacgtaggtggcgagcgttgtccggaattactgggcgtaaagagtgcgtaggcggatatttaagtgagatgtgaaatacccgggcttaacccgggcactgcatttcaaactggatatctagagtgcgggagaggagaatggaattcctagtgtagcggtgaaatgcgtagagattaggaagaacaccagtggcgaaggcgattctctggaccgtaactgacgctgaggcacgaaagcgtgggtagcaaacaggattagataccctggtagtccacgccgtaaacgatgagtactaggtgtaggaggtatcgaccccttctgtgccgcagtaaacacaataagtactccgcctgggaagtacgatcgcaagattaaaactcaaaggaattgacgggggcccgcacaagcagcggagcatgtggtttaattcgaagcaacgcgaagaaccttacctggacttgacataccctgaatatcttagagataagagaagcccttcggggcagggatacaggtggtgcatggttgtcgtcagctcgtgtcgtgagatgttaggttaagtcctgcaacgagcgcaacccctgttgttagttgctaacatttagttgagcactctagcaagactgccgcggttaacgcggaggaaggtggggatgacgtcaaatcatcatgccccttatgtccagggcaacacacgtgctacaatgggcagtacagagagaagcaagaccgcaaggtggagcaaacctcaaaaactgcccccagttcggattgcaggctgaaactcgcctacatgaagttggagttgctagtaatcgcgaatcagaatgtcgcggtgaatacgttcccgggccttgtacacaccgcccgtcacaccatgagagctggcaacacccgaagtccgtagtctaacgaaagaggacgcggccgaaggtggggttagtaattggggtgaagtcgtaacaaggtagccgtaggagaacctgcggctggatcacctcctttcta

SEQ ID NO: 2764 - DNA, 2099 bp, Clostridium felsineum
  ref <308>: DATABASE ACCESSION NUMBER: NCBI ACCESSION: NZ_LZYT01000069.1
  ref <309>: DATABASE ENTRY DATE: 2019-04-01
  ref <313>: RELEVANT RESIDUES IN SEQ ID NO: (1)..(2099)
ttttaaattgagagtttgatcctggctcaggacgaacgctggcggcgtgcttaacacatgcaagtcgagcggggaacttcggttcccagcggcggacgggtgagtaacacgtgggtaacctgcctcatagtggggaatagccttccgaaaggaagattaataccgcataatactcggaaatcacatgatttctgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgataatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaagtcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtagggacaaaaagatgctataccgcaaggtggagctaaactcaaaaccctatcccagttcggattgtaggctgaaactcgcctacatgaagccggagttgctagtaatcgcgaatcagaatgtcgcggtgaatacgttccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaaatcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtagggacaaaaagatgctataccgcaaggtggagctaaactcaaaaccctatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgatgattggggtgaagtcgtaacaaggtagccgtaggagaacctgcggctggatcacctcctttcta

SEQ ID NO: 2765 - DNA, 1540 bp, Clostridium formicaceticum
  ref <308>: DATABASE ACCESSION NUMBER: NCBI ACCESSION: NZ_CP020559.1
  ref <309>: DATABASE ENTRY DATE: 2019-04-01
  ref <313>: RELEVANT RESIDUES IN SEQ ID NO: (1)..(1540)
ttttttattaagagtttgatcctggctcaggatgaacgctggcggcgtgcctaacacatgcaagtcgagcgaaccgatttatcggaagccttcgggtggaagatgatgaggttagcggcggacgggtgagtaacgcgtgggtaacctaccttgtacagggggataacagtcggaaacgattgctaataccgcataaagctattttaaggcatcttagaatagccaaagatttattggtacaagatgggcccgcgtctgattagctagttggtggggtaaaggcctaccaaggcgacgatcagtagccgacctgagagggtgaccggccacactggaactgagacacggtccagactcctacgggaggcagcagtgggggatattgcacaatgggggaaaccctgatgcagcgacgccgcgtgagcgaagaaggccttcgggtcgtaaagctctgtttcgagggaagaaaaatgacggtacctcgggaggaagccccggctaactacgtgccagcagccgcggtaatacgtagggggcaagcgttatccggaatcactgggcgtaaagggtgcgtaggcggccaataaagtctagggtgaaaggctacggctcaaccgtagtaagccttggaaacttattggcttgagtgcaggagaggagagtggaattcctagtgtagcggtgaaatgcgtagatattaggaggaacaccagtggcgaaggcgactctctggactgtaactgacgctgaggcacgaaagcgtggggagcgaacaggattagataccctggtagtccacgccgtaaacgatgagtgctaggtgttgggggtcaaacctcagtgccgcagctaacgcattaagcactccgcctggggagtacgcacgcaagtgtgaaactcaaaggaattgacggggacccgcacaagcagcggagcatgtggtttaattcgaagcaacgcgaagaaccttacctggacttgacatccttatgaccgctttttaacagaagctttcccttcggggacagaagtgacaggtggtgcatggttgtcgtcagctcgtgtcgtgagatgttgggttaagtcccgcaacgagcgcaacccttgtctttagttgccagcatttcggatgggcactctagagagactgccggggacaactcggaggaaggtggggatgacgtcaaatcatcatgccccttatgttcagggctacacacgtgctacaatggccgatacaaagggcagcgaaggagtaatctggagcgaatctcataaagtcggtctcagttcggattgtgggctgaaactcgcccacatgaagttggagttgctagtaatcgcgaatcagaatgtcgcggtgaatgcgttcccgggtcttgtacacaccgcccgtcacaccatgggagtcggaagcgcccgaagccagctactttaaccgaaaggagagagctgtcgaaggtgaagccgatgactggggtgaagtcgtaacaaggtagccgtatcggaaggtgcggctggatcacctcctttctaagga

SEQ ID NO: 2766 - DNA, 351 bp, Clostridium homopropionicum
  ref <308>: DATABASE ACCESSION NUMBER: NCBI ACCESSION: NZ_FOOL01000013.1
  ref <309>: DATABASE ENTRY DATE: 2019-04-01
  ref <313>: RELEVANT RESIDUES IN SEQ ID NO: (1)..(351)
ttttaaattgagagtttgatcctggctcaggacgaacgctggcggcgtgcctaacacatgcaagtcgagcgaggggagttcttcggaacaaacctagcggcggacgggtgagtaacacgtgggcaacctgcctcaaagaggggaatagcctcccgaaagggagattaataccgcataaagttattttttcgcatgaagagataaccaaaggagcaatccgctttgagatgggcccgcggcgcattagctagttggtgaggtaacggctcaccaaggcgacgatgcgtagccgacctgagagggtgatcggccacattggaactgagacacggtccagactcctacgggagg

SEQ ID NO: 2767 - DNA, 1422 bp, Clostridium intestinale
  ref <308>: DATABASE ACCESSION NUMBER: NCBI ACCESSION: NZ_FQXU01000002.1
  ref <309>: DATABASE ENTRY DATE: 2019-04-01
  ref <313>: RELEVANT RESIDUES IN SEQ ID NO: (1)..(1422)
gagtaacacgtgggcaacctgcctgatagagggggatagcctcccgaaagggagattaataccgcataaagtcaaatgaaggcatcttcaaatgaccaaaggagtaatccgctatcagatgggcccgcggcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgaaggccttcgggttgtaaagctctgtcttcagggacgataatgacggtacctgaggaggaagccacggctaactacgtgccagcagccgcggtaatacgtaggtggcaagcgttgtccggatttactgggcgtaaagggagcgtaggcggatacttaagtgggatgtgaaatacctgggcttaacttgggtgctgcattccaaactgggtgtctagagtgttggagaggaaagtggaattcctagtgtagcggtgaaatgcgtagagattaggaagaacaccagtggcgaaggcgactttctggacaataactgacgctgaggctcgaaagcgtggggagcaaacaggattagataccctggtagtccacgccgtaaacgatgggtactaggtgtagggggtatcgactccccctgtgccgccgttaacacaataagtaccccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagttctcccttcggggaggacaggaagacaggtggtgcatggttgtcgtcagctcgtgtcgtgagatgttgggttaagtcccgcaacgagcgcaacccttattgttagttgctaccatttagttgagcactctagcaagactgccgtggttaacgcggaggaaggtggggatgacgtcaaatcatcatgccccttatgtctagggctacacacgtgctacaatggcgagtacaaagagacgcaaagccgcgaggtggagcaaaacttataaaactcgtctcagttcggattgcaggctgaaactcgcctgcatgaagctggagttgctagtaatcgcgaatcagaatgtcgcggtgaatacgttcccgggccttgtacacaccgcccgtcacaccatgagagttggcaatacccgaagtccgtagcctaaccttttaggagggcgcggccgaaggtagggtcagcgattggggtgaagtcgtaacaaggtagccgtaggagaacctgcggctggatcacctcctttctatgga

SEQ ID NO: 2768 - DNA, 1321 bp, Clostridium jeddahense
  ref <308>: DATABASE ACCESSION NUMBER: NCBI ACCESSION: NZ_CBYL010000093.1
  ref <309>: DATABASE ENTRY DATE: 2019-04-01
  ref <313>: RELEVANT RESIDUES IN SEQ ID NO: (1)..(1321)
ggtatcaaaggagcaatccgctgaaagatggactcgcgtccgattagccagttggcggggtaaaggcccaccaaagcgacgatcggtagccgggttgagagactgaacggccacattgggactgagacacggcccagactcctacgggaggcagcagtgggggatattgcacaatggaggaaactctgatgcagcaatgccgcgtgagggaagacggtcttcggattgtaaacctctgtccttggtgaagataatgacggtagccaaggaggaagctccggctaactacgtgccagcagccgcggtaatacgtagggagcaagcgttgtccggatttactgggtgtaaagggtgcgtaggcggctttttaagtcgggcgtgaaagctgtgggcttaacccacaaattgcgttcgaaactggaaggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaggcagagatgcattaggtgcccttcggggaaagttgagacaggtggtgcatggttgtcgtcagctcgtgtcgtgagatgttgggttaagtcccgcaacgagcgcaacccttgtgattagttgctacgcaagagcactctaatcagactgccgttgacaaaacggaggaaggtggggacgacgtcaaatcatcatgccccttatgacctgggctacacacgtactacaatggtcgctaacagagggaagccaagccgcgaggtggagcaaacccccaaaagcgatctcagttcggattgtaggctgcaacccgcctacatgaagttggaattgctagtaatcgcggatcagcatgccgcggtgaatacgttcccgggccttgtacacaccgcccgtcacaccatgggagccggtaatacccgaagccaatagtctaaccgcaagggggacgttgtcgaaggtaggattggcgactggggtgaagtcgtaacaaggtagccgtatcggaaggtgcggctggatcacctcctttctatgga

SEQ ID NO: 2769 - DNA, 1519 bp, Clostridium kluyveri
  ref <308>: DATABASE ACCESSION NUMBER: NCBI ACCESSION: NZ_CP018335.1
  ref <309>: DATABASE ENTRY DATE: 2019-04-01
  ref <313>: RELEVANT RESIDUES IN SEQ ID NO: (1)..(1519)
ttttaaattaagagtttgatcctggctcaggacgaacgctggcggcgtgcctaacacatgcaagtcgagcgaagaagtcccttcggggatggattagcggcggacgggtgagtaacacgtgggtaacctggctcaaagagggggatagcctcccgaaagggagattaataccgcataaaaggtaaatatcgcatggtaaataccttaaaggagaaatccgctttgagatgggcccgcgtcgcattagctagttggagggataaaagccccccaaggcgacgatgcgtagccgacctgagagggtgaacggccacattggaactgagatacggtccagactcctacgggaggcagcagtggggaatattgcacaatgggggaaaccctgatgcagcaacgccgcgtgagtgaagaaggttttcggatcgtaaagctctgtcatccgggacgataatgacggtaccggaagaggaagccacggctaactacgtgccagcagccgcggtaatacgtaggtggcgagcgttgtccggaattactgggcgtaaagggtgtgcaggcggatatttaagtgagatgtgaaagacccgggcttaacccgggcagtgcatttcaaactggatatctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaacgatgagtactaggtgtagggggtatcgaccccccctgtgccgcagtaaacacaataagtactccgcctgggaagtacgatcgcaagattaaaactcaaaggaattgacggggacccgcacaagcagcggagcatgtggtttaattcgaagcaacgcgaagaaccttacctggacttgacatcccctgaataactcgtaatggaggaagcccttcggggcagggagacaggtggtgcatggttgtcgtcagctcgtgtcgtgagatgttaggttaagtcctgcaacgagcgcaacccctgtcgttagttgccatcacgtaaaggtgggcaccctaacgagactgccgcggttaacgtggaggaaggtggggatgacgtcaaatcatcatgccccttatgtccagggcaacacacgtgctacaatgggcagaacagagagaagcaataccgcgaggaggagcaaatctcaaaaactgcccccagttcggattgcaggctgaaacccgcctgcatgaagttggagttgctagtaatcgcgaatcagcatgtcgcggtgaatacgttcccgggtcttgtacacaccgcccgtcacaccatgagagctggcaacacccgaagtccgtagtctaaccaaaaggaggacgcggccgaaggtggggttagtgattggggtgaagtcgtaacaaggtagccgtaggagaacctgcggctggatcacctcctttcta

SEQ ID NO: 2770 - DNA, 1000 bp, Clostridium ljungdahlii
  ref <308>: DATABASE ACCESSION NUMBER: NCBI ACCESSION: NZ_LITS01000038.1
  ref <309>: DATABASE ENTRY DATE: 2019-04-01
  ref <313>: RELEVANT RESIDUES IN SEQ ID NO: (1)..(1000)
ttttaaattaagagtttgatcctggctcaggacgaacgctggcggcgtgcttaacacatgcaagtcgagcgatgaagctccttcgggagtggattagcggcggacgggtgagtaacacgtgggtaacctacctcaaagagggggatagcctcccgaaagggagattaataccgcataataatcggttttcacatggagactgatttaaaggagtaatccgctttgagatggacccgcggcgcattagctagttggtagggtaacggcctaccaaggcgacgatgcgtagccgacctgagagggtgatcggccacattggaactgagagacggtccagactcctacgggaggcagcagtggggaatattgcacaatgggcgaaagcctgatgcagcaacgccgcgtgagtgaagaaggttttcggattgtaaagctctgtctttggggacgataatgacggtacccaaggaggaagccacggctaactacgtgccagcagccgcggtaatacgtaggtggcgagcgttgtccggaattactgggcgtaaagagtgcgtaggcggatatttaagtgagatgtgaaatacccgggcttaacccgggcactgcatttcaaactggatatctagagtgcgggagaggagaatggaattcctagtgtagcggtgaaatgcgtagagattaggaagaacaccagtggcgaaggcgattctctggaccgtaactgacgctgaggcacgaaagcgtgggtagcaaacaggattagataccctggtagtccacgccgtaaacgatgagtactaggtgtaggaggtatcgaccccttctgtgccgcagtaaacacaataagtactccgcctgggaagtacgatcgcaagattaaaactcaaaggaattgacgggggcccgcacaagcagcggagcatgtggtttaattcgaagcaacgcgaagaaccttacctggacttgacataccctgaatatcttagagataagagaa

SEQ ID NO: 2771 - DNA, 246 bp, Clostridium lundense
  ref <308>: DATABASE ACCESSION NUMBER: NCBI ACCESSION: NZ_JHVC01000027.1
  ref <309>: DATABASE ENTRY DATE: 2019-04-01
  ref <313>: RELEVANT RESIDUES IN SEQ ID NO: (1)..(246)
ttttaaattgagagtttgatcctggctcaggacgaacgctggcggcgtgcctaacacatgcaagtcgagcgatgaaatccctacggaaatggattagcggcggacgggtgagtaacacgtgggcaacctgcctcaaagtgggggatagccctccgaaaggaggattaataccgcataatgttaagtttttgcataaagacttaaccaaaggagtaatccgctttgagatgggcccgcggtgcatta

SEQ ID NO: 2772 - DNA, 450 bp, Clostridium magnum
  ref <308>: DATABASE ACCESSION NUMBER: NCBI ACCESSION: NZ_FQXL01000002.1
  ref <309>: DATABASE ENTRY DATE: 2019-04-01
  ref <313>: RELEVANT RESIDUES IN SEQ ID NO: (1)..(450)
gtttttcgcatgaagaactaattaaaggagtaatccgctttgagatggacccgcggcgcattagctagttggtgaggtaaaggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtcttttgggacgataatgacggtaccaaaggaggaagccacggctaactacgtgccagcagccgcggtaatacgtaggtggcgagcgttgtccggatttactgggcgtaaaggatgcgtaggcggatatttaagtgagatgtgaaatacccgagcttaacttgggtgctgcatttcaaactggatatctagagtg

SEQ ID NO: 2773 - DNA, 1519 bp, Clostridium massiliodielmoense
  ref <308>: DATABASE ACCESSION NUMBER: NCBI ACCESSION: NZ_FXLO01000004.1
  ref <309>: DATABASE ENTRY DATE: 2019-04-01
  ref <313>: RELEVANT RESIDUES IN SEQ ID NO: (1)..(1519)
ttttaaattgagagtttgatcctggctcaggacgaacgctggcggcgtgcctaacacatgcaagtcgagcgatgaaacttccttcgggaagtggattagcggcggacgggtgagtaacacgtgggtaacctgcctcaaagagtgggatagccttccgaaaggaagattaataccgcataacattatcttgtggcatcacaggataatcaaaggagcaatccgctttgagatggacccgcggcgcattagctagttggtaaggtaatggcttaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggttttcggatcgtaaaactctgtctttggggacgataatgacggtacccaaggaggaagccacggctaactacgtgccagcagccgcggtaatacgtaggtggcaagcgttgtccggatttactgggcgtaaagagtatgtaggtgggcatttaagtcagatgtgaaattcccgggcttaacctgggagctgcatttgatactgggtgtctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcgtaatagaggaagtcccttcggggacaggaagacaggtggtgcatggttgtcgtcagctcgtgtcgtgagatgttgggttaagtcccgcaacgagcgcaacccttattattagttgctactattaagttaagcactctaatgagactgccgcggttaacgtggaggaaggtggggatgacgtcaaatcatcatgccccttatgtctagggctacacacgtgctacaatggctggtacaacgagcagcaaacccgcgagggggagcaaaacttgaaagccagtcccagttcggattgtaggctgaaactcgcctacatgaagttggagttgctagtaatcgcgaatcagcatgtcgcggtgaatacgttcccgggtcttgtacacaccgcccgtcacaccatgagagccggtaacacccgaagcccgtgaggtaaccgtaaggagccagcggtcgaaggtgggattggtgattggggtgaagtcgtaacaaggtagccgtaggagaacctgcggctggatcacctcctttcta

SEQ ID NO: 2774 - DNA, 1525 bp, Clostridium merdae
  ref <308>: DATABASE ACCESSION NUMBER: NCBI ACCESSION: NZ_FXLN01000003.1
  ref <309>: DATABASE ENTRY DATE: 2019-04-01
  ref <313>: RELEVANT RESIDUES IN SEQ ID NO: (1)..(1525)
ttttagagagtttgatcctggctcaggacgaacgctggcggcatgcctaacacatgcaagtcgaacggagtaagagagaagcttgcttagctcttacttagtggcggacgggtgagtaacgcgtgagtaacctgcctttcagagggggataacgttctgaaaagaacgctaataccgcataacatattggtgtcgcatggcactggtatcaaaggagcaatccgctgaaagatggactcgcgtccgattagctagttggtggggtaaaggcctaccaaggcgacgatcggtagccgggttgagagactgaacggccacattgggactgagacacggcccagactcctacgggaggcagcagtgggggatattgcacaatgggcgaaagcctgatgcagcaatgccgcgtgagggaagacggttttcggattgtaaacctctgtccttggtgaagataatgacggtagccaaggaggaagctccggctaactacgtgccagcagccgcggtaatacgtagggagcaagcgttgtccggatttactgggtgtaaagggtgcgtaggcggctctttaagtcgggcgtgaaagctgtgggctcaacccacaaattgcgttcgaaactggagagcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaagcagagatgcattaggtgcccttcggggaaagttgagacaggtggtgcatggttgtcgtcagctcgtgtcgtgagatgttgggttaagtcccgcaacgagcgcaacccctgtgattagttgctacgcaagagcactctaatcagactgccgttgacaaaacggaggaaggtggggacgacgtcaaatcatcatgccccttatgacctgggctacacacgtactacaatggtcgctaacagagggaagccaagccgcgaggtggagcaaacccccaaaagcggtctcagttcggattgtaggctgcaacccgcctacatgaagttggaattgctagtaatcgcggatcagcatgccgcggtgaatacgttcccgggccttgtacacaccgcccgtcacaccatgggagccggtaatacccgaagccaatagtctaaccgcaaggaggacgttgtcgaaggtaggattggcgactggggtgaagtcgtaacaaggtagccgtatcggaaggtgcggctggatcacctcctttctatgga

SEQ ID NO: 2775 - DNA, 1518 bp, Clostridium niameyense
  ref <308>: DATABASE ACCESSION NUMBER: NCBI ACCESSION: NZ_LN849007.1
  ref <309>: DATABASE ENTRY DATE: 2019-04-01
  ref <313>: RELEVANT RESIDUES IN SEQ ID NO: (1)..(1518)
ttttaaattgagagtttgatcctggctcaggacgaacgctggcggcgtgcttaacacatgcaagtcgagcgatgaagcttccttcgggaagtggattagcggcggacgggtgagtaacacgtgggcaacctgcctcaaagtgggggatagccctccgaaaggaggattaataccgcataacatgagagaatcgcatgattttttcatcaaagatttattgctttgagatgggcccgcggcgcattagctagttggtgaggtaacagctcaccaaggcaacgatgcgtagccgacctgagagggtgatcggccacattggaactgagatacggtccagactcctacgggaggcagcagtggggaatattgcgcaatgggggaaaccctgacgcagcaacgccgcgtgagtgatgaaggtcttcggattgtaaagctctgttttctgggacgataatgacggtaccagaggaggaagccacggctaactacgtgccagcagccgcggtaatacgtaggtggcgagcgttgtccggatttactgggcgtaaagagtgcgtaggcggatgcttaagtgagatgtgaaatacccgggcttaacttgggggctgcatttcaaactgggcatctagagtacaggagaggaaagcggaattcctagtgtagcggtgaaatgcgtagatattaggaagaacaccagtggcgaaggcggctttctggactgtaactgacgctgaggcacgaaagcgtgggtagcaaacaggattagataccctggtagtccacgccgtaaacgatggatactaggtgtaggaggtatcaactccttctgtgccgcagttaacacattaagtatcccgcctggggagtacggtcgcaagattaaaactcaaaggaattgacgggggcccgcacaagcagcggagcatgtggtttaattcgaagcaacgcgaagaaccttacctggacttgacatcccctgaataacctagagataggcgaagcccttcggggcagggagacaggtggtgcatggttgtcgtcagctcgtgtcgtgagatgttaggttaagtcctgcaacgagcgcaaccccttttattagttgctaccattaagttgagcactctaatgagactgcccgggtaaccgggaggaaggtggggatgacgtcaaatcatcatgccccttatgtccagggctacacacgtgctacaatggtaggtacaaaaagatgcaatatcgtgaggtggagcaaaacttttaaaacctatctcagttcggattgtaggctgcaactcgcctacatgaagctggagttgctagtaatcgcaaatcagaatgttgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttcta

SEQ ID NO: 2776 - DNA, 1505 bp, Clostridium oryzae
  ref <308>: DATABASE ACCESSION NUMBER: NCBI ACCESSION: NZ_MZGV01000157.1
  ref <309>: DATABASE ENTRY DATE: 2019-04-01
  ref <313>: RELEVANT RESIDUES IN SEQ ID NO: (1)..(1505)
ttgagagtttgatcctggctcaggacgaacgctggcggcgtgcctaacacatgcaagtcgagcgagagacttcggtctctagcggcggacgggtgagtaacacgtgggtaacctgcctcatagagggggatagcctcccgaaagggagattaataccgcataagaagtagataccgcatggtatcagctttaaaggagaaatccgctatgagatggacccgcggcgcattagctagttggtgaggtaagggctcaccaaggcgacgatgcgtagccggcctgagagggcgaacggccacattggaactgagagacggtccagactcctacgggaggcagcagtggggaatattgcacaatgggggaaaccctgatgcagcaacgccgcgtgaaggaagaaggccttcgggttgtaaacttctgttaatggggacgataatgacggtacccatagaggaagccacggctaactacgtgccagcagccgcggtaatacgtaggtggcgagcgttgtccggaattactgggcgtaaaggatgcgtaggcggataattaagtgagatgtgaaatacccgggcttaacctggggggtgcatttcaaactggttgtctagagtgcaggagaggaaagtggaatttctagtgtagcggtgaaatgcgtagatattaggaagaacaccagtggcgaaggcgactttctggactgtaactgacgctgaggcatgaaagcgtggggagcaaacaggattagataccctggtagtccacgccgtaaacgatgaatactaggtgtgggagttgtcatgacttccgtgccgccgtaaacacattaagtattccgcctggggagtacggtcgcaagattaaaactcaaaggaattgacgggggcccgcacaagcagcggagcatgtggtttaattcgaagcaacgcgaagaaccttacctggacttgacatctcctgaataaatctgtaatggatgaagctcttcggagcaggaagacaggtggtgcatggttgtcgtcagctcgtgtcgtgagatgttgggttaagtcccgcaacgagcgcaacccttatagttagttgccagcacgttatggtgggcactctagcgagactgccggggttaactcggaggaaggtggggatgacgtcaaatcatcatgccccttatgtccagggcgacacacgtgctacaatggcgagaacaaagagaagcaagaccgtgaggtggagcaaaactgataaaactcgtcccagttcggattgtaggctgaaactcgcctacatgaagccggagttgctagtaatcgcgaatcagaatgtcgcggtgaatacgttcccgggccttgtacacaccgcccgtcacaccatgagagttggcaatacccgaagtccgtgagttaaccgaaaggggacagcggccgaaggtagggtcagcgattggggtgaagtcgtaacaaggtagccgtaggagaacctgcggctggatcacctcctttcta

SEQ ID NO: 2777 - DNA, 1513 bp, Clostridium pasteurianum
  ref <308>: DATABASE ACCESSION NUMBER: NCBI ACCESSION: NZ_LFYL01000007.1
  ref <309>: DATABASE ENTRY DATE: 2019-04-01
  ref <313>: RELEVANT RESIDUES IN SEQ ID NO: (1)..(1513)
ttataaattgagagtttgatcctggctcaggacgaacgctggcggcgtgcttaacacatgcaagtcgagcgagaaaccttcgggtttctagcggcggacgggtgagtaacacgtgggtaacctgcctcaaagaggggaatagcctcccgaaagggagattaataccgcataatattaaagtttcacatggagctttaattaaaggagtaatccgctttgagatggacccgcggcgcattagctagttggagaggtaacggctcaccaaggcgacgatgcgtagccgacctgagagggtgatcggccacattggaactgagacacggtccagactcctacgggaggcagcagtggggaatattgcacaatgggcgaaagcctgatgcagcaacgccgcgtgagtgatgacggtcttcggattgtaaagctctgtcttttgggacgataatgacggtaccaaaggaggaagccacggctaactacgtgccagcagccgcggtaatacgtaggtggcaagcgttgtccggatttactgggcgtaaaggatgtgtaggcggatacttaagtgagatgtgaaagccccgggctcaacctggggactgcatttcaaactgggtatctagagtgcaggagaggaaagcggaattcctagtgtagcggtgaaatgcgtagagattaggaagaacatcagtggcgaaggcggctttctggactgtaactgacgctgaggcatgaaagcgtggggagcaaacaggattagataccctggtagtccacgccgtaaacgatgagtactaggtgtaggaggtatcgactccttctgtgccgcagttaacacaataagtactccgcctgggaagtacggtcgcaagattaaaactcaaaggaattgacgggggcccgcacaagcagcggagcatgtggtttaattcgaagcaacgcgaagaaccttacctagacttgacatctcctgaatagcgtagagatacgtgaagcccttcggggcaggaagacaggtggtgcatggttgtcgtcagctcgtgtcgtgagatgttgggttaagtcccgcaacgagcgcaacccttatcattagttgctaccattaagttgagcactctagtgagactgcccgggttaaccgggaggaaggcggggatgacgtcaaatcatcatgccccttatgtctagggctacacacgtgctacaatggtgagaacaacgagatgcaataccgtgaggtggagctaaacttgaaaactcatcccagttcggattgcaggctgaaattcgcctgcatgaagttggagttgctagtaatcgcgaatcagaatgtcgcggtgaatacgttcccgggccttgtacacaccgcccgtcacaccatgagagctggtaacacccgaagtccgtgaggtaacctttatggggccagcggccgaaggtgggattagtgattggggtgaagtcgtaacaaggtagccgtaggagaacctgcggctggatcacctcctttcta

SEQ ID NO: 2778 - DNA, 1539 bp, Clostridium phoceensis
  ref <308>: DATABASE ACCESSION NUMBER: NCBI ACCESSION: NZ_LN866274.1
  ref <309>: DATABASE ENTRY DATE: 2019-04-01
  ref <313>: RELEVANT RESIDUES IN SEQ ID NO: (1)..(1539)
ttttattgagagtttgatcctggctcaggatgaacgctggcggcgtgcttaacacatgcaagtcgaacggagtgccttagaaagaggattcgtccaattgataaggttacttagtggcggacgggtgagtaacgcgtgaggaacctgcctcggagtggggaataacagaccgaaaggcctgctaataccgcatgatgcagttggaccgcatggtcctgactgccaaagatttatcgctctgagatggcctcgcgtctgattagcttgttggcggggtaatggcccaccaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttctcagggacgaacaaatgacggtacctgaggaataagccacggctaactacgtgccagcagccgcggtaatacgtaggtggcaagcgttatccggatttactgggtgtaaagggcgtgtaggcgggaaggcaagtcagatgtgaaaactatgggctcaacccatagcctgcatttgaaactgtttttcttgagtgctggagaggcaatcggaattccgtgtgtagcggtgaaatgcgtagatatacggaggaacaccagtggcgaaggcggattgctggacagtaactgacgctgaggcgcgaaagcgtggggagcaaacaggattagataccctggtagtccacgctgtaaacgatggatactaggtgtggggggtctgaccccctccgtgccgcagttaacacaataagtatcccacctggggagtacgatcgcaaggttgaaactcaaaggaattgacgggggcccgcacaagcggtggagtatgtggtttaattcgaagcaacgcgaagaaccttaccagggcttgacatcctactaacgaagcagagatgcattaggtgcccttcggggaaagtagagacaggtggtgcatggttgtcgtcagctcgtgtcgtgagatgttgggttaagtcccgcaacgagcgcaacccttattgttagttgctacgcaagagcactctagcgagactgccgttgacaaaacggaggaaggcggggacgacgtcaaatcatcatgccccttatgtcctgggctacacacgtactacaatggtggtaaacagagggaagcaagaccgcgaggtggagcaaatccctaaaagccatcccagttcggattgcaggctgaaacccgcctgtatgaagttggaatcgctagtaatcgcggatcagcatgccgcggtgaatacgttcccgggccttgtacacaccgcccgtcacaccatgagagtcgggaacacccgaagtccgtagtctaaccgcaagggggacgcggccgaaggtgggttcgataattggggtgaagtcgtaacaaggtagccgtatcggaaggtgcggctggatcacctcctttctaagga

SEQ ID NO: 2779 - DNA, 1520 bp, Clostridium puniceum
  ref <308>: DATABASE ACCESSION NUMBER: NCBI ACCESSION: NZ_LZZM01000091.1
  ref <309>: DATABASE ENTRY DATE: 2019-04-01
  ref <313>: RELEVANT RESIDUES IN SEQ ID NO: (1)..(1520)
ttttaattgagagtttgatcctggctcaggacgaacgctggcggcgtgcttaacacatgcaagtcgagcgatgaagttccttcgggaatggattagcggcggacgggtgagtaacacgtgggtaacctgcctcatagaggggaatagcctttcgaaaggaagattaataccgcataagattgtagtttcgcatgaaacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaaactctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagcccctcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgcaataccgtgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatgga

SEQ ID NO: 2780 - DNA, 1428 bp, Clostridium ragsdalei
  ref <308>: DATABASE ACCESSION NUMBER: NCBI ACCESSION: NZ_LROS01000056.1
  ref <309>: DATABASE ENTRY DATE: 2019-04-01
  ref <313>: RELEVANT RESIDUES IN SEQ ID NO: (1)..(1428)
gtggattagcggcggacgggtgagtaacacgtgggtaacctacctcaaagagggggatagcctcccgaaagggagattaataccgcataataatcagttttcacatggagattgatttaaaggagtaatccgctttgagatggacccgcggcgcattagctagttggtagggtaacggcctaccaaggcgacgatgcgtagccgacctgagagggtgatcggccacattggaactgagagacggtccagactcctacgggaggcagcagtggggaatattgcacaatgggcgaaagcctgatgcagcaacgccgcgtgagtgaagaaggttttcggattgtaaagctctgtctttggggacgataatgacggtacccaaggaggaagccacggctaactacgtgccagcagccgcggtaatacgtaggtggcgagcgttgtccggaattactgggcgtaaagagtgcgtaggcggatatttaagtgagatgtgaaatacccgggcttaacccgggcactgcatttcaaactggatatctagagtgcgggagaggagaatggaattcctagtgtagcggtgaaatgcgtagagattaggaagaacaccagtggcgaaggcgattctctggaccgtaactgacgctgaggcacgaaagcgtgggtagcaaacaggattagataccctggtagtccacgccgtaaacgatgagtactaggtgtaggaggtatcgaccccttctgtgccgcagtaaacacaataagtactccgcctgggaagtacgatcgcaagattaaaactcaaaggaattgacgggggcccgcacaagcagcggagcatgtggtttaattcgaagcaacgcgaagaaccttacctggacttgacataccctgaatatcttagagataagagaagcccttcggggcagggatacaggtggtgcatggttgtcgtcagctcgtgtcgtgagatgttaggttaagtcctgcaacgagcgcaacccctgttgttagttgctaacatttagttgagcactctagcaagactgccgcggttaacgcggaggaaggtggggatgacgtcaaatcatcatgccccttatgtccagggcaacacacgtgctacaatgggcagtacagagagaagcaagaccgcgaggtggagcaaacctcaaaaactgcccccagttcggattgtaggctgaaactcgcctacatgaagttggagttgctagtaatcgcgaatcagaatgtcgcggtgaatacgttcccgggccttgtacacaccgcccgtcacaccatgagagctggcaacacccgaagtccgtagtctaacttaggaggacgcggccgaaggtggggttagtaattggggtgaagtcgtaacaaggtagccgtaggagaacctgcggctggatcacctcctttcta

SEQ ID NO: 2781 - DNA, 1512 bp, Clostridium roseum
  ref <308>: DATABASE ACCESSION NUMBER: NCBI ACCESSION: NZ_LZYV01000012.1
  ref <309>: DATABASE ENTRY DATE: 2019-04-01
  ref <313>: RELEVANT RESIDUES IN SEQ ID NO: (1)..(1512)
ttttaaattgagagtttgatcctggctcaggacgaacgctggcggcgtgcttaacacatgcaagtcgagcggggaacttcggttcccagcggcggacgggtgagtaacacgtgggtaacctgcctcatagtggggaatagccttccgaaaggaagattaataccgcataatactcggaaatcacatgatttctgagccaaaggatttattcgctatgagatggacccgcggcgcattagcttgttggtgaggtaacggctcaccaaggcttcgatgcgtagccgacctgagagggtgatcggccacattggaactgagacacggtccagactcctacgggaggcagcagtggggaatattgcacaatgggggaaaccctgatgcagcaacgccgcgtgagtgatgaaggtcttcggatcgtaaaactctgtcttatgggacgataatgacggtaccataggaggaagccacggctaactacgtgccagcagccgcggtaatacgtaggtggcaagcgttgtccggatttactgggcgtaaaggatgtgtaggcggatatttaagtgagatgtgaaatccccgggcttaacttgggggctgcatttcaaactggatgtctggagtgcaggagaggaaggcagaattcctagtgtagcggtgaaatgcgtagagattaggaagaataccagtggcgaaggcggccttctggactgtaactgacgctgaggcatgaaagcgtggggagcaaacaggattagataccctggtagtccacgccgtaaacgatgaatactaggtgtaggaggtatcgactccttctgtgccgcagttaacacaataagtattccgcctgggaagtacggtcgcaagattaaaactcaaaggaattgacggggacccgcacaagcagcggagcatgtggtttaattcgaagcaacgcgaagaaccttacctagacttgacatctcctgaattagtccgtaatggatgaaatcccttcggggacaggatgacaggtggtgcatggttgtcgtcagctcgtgtcgtgagatgttgggttaagtcccgcaacgagcgcaacccttatcattagttgctaacatttagttgagcactctagtgagactgcccgggttaaccgggaggaaggtggggatgacgtcaaatcatcatgccccttatgtctagggctacacacgtgctacaatggtagggacaaaaagatgctataccgcaaggtggagctaaactcaaaaccctatcccagttcggattgtaggctgaaactcgcctacatgaagccggagttgctagtaatcgcgaatcagaatgtcgcggtgaatacgttcccgggtcttgtacacaccgcccgtcacaccatgagagtcggcaacacccgaagcccgtgaggtaaccttttggaaccagcggtcgaaggtggggttgatgattggggtgaagtcgtaacaaggtagccgtaggagaacctgcggctggatcacctcctttcta

SEQ ID NO: 2782 - DNA, 981 bp, Clostridium saccharobutylicum
  ref <308>: DATABASE ACCESSION NUMBER: NCBI ACCESSION: NZ_LZZA01000010.1
  ref <309>: DATABASE ENTRY DATE: 2019-04-01
  ref <313>: RELEVANT RESIDUES IN SEQ ID NO: (1)..(981)
gtaaagggagcgtaggtggatatttaagtgggatgtgaaatactcgggcttaacttgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatagaggaagcccttcggggcaggaagacaggtggtgcatggttgtcgtcagctcgtgtcgtgagatgttgggttaagtcccgcaacgagcgcaacccttattgttagttgctaccattaagttgagcactctagcgagactgcccgggttaaccgggaggaaggtggggatgacgtcaaatcatcatgccccttatgtctagggctacacacgtgctacaatggctggtacagagagatgctaaaccgtgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgtaagcgaggcagcgacctaaggtagggtcagcgattggggtgaagtcgtaacaaggtagccgtaggagaacctgcggctggatcacctcctttctatggaga

SEQ ID NO: 2783 - DNA, 1518 bp, Clostridium saccharoperbutylacetonicum
  ref <308>: DATABASE ACCESSION NUMBER: NCBI ACCESSION: NZ_CP016087.1
  ref <309>: DATABASE ENTRY DATE: 2019-04-01
  ref <313>: RELEVANT RESIDUES IN SEQ ID NO: (1)..(1518)
tttttattgagagtttgatcctggctcaggacgaacgctggcggcgtgcttaacacatgcaagtcgagcgatgaagttccttcgggaatggattagcggcggacgggtgagtaacacgtgggtaacctgcctcatagaggggaatagcctttcgaaaggaagattaataccgcataagattgtagtaccgcatggtgcagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagcccttcggggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggctggtacagagagatgctaaaccgcgaggtggagccaaactttaaaaccagtctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaacgcgcaagcgaggcagcgacctaaggtagggtcagcgattggggtgaagtcgtaacaaggtagccgtaggagaacctgcggctggatcacctcctttcta

SEQ ID NO: 2784 - DNA, 1519 bp, Clostridium scatologenes
  ref <308>: DATABASE ACCESSION NUMBER: NCBI ACCESSION: NZ_CP009933.1
  ref <309>: DATABASE ENTRY DATE: 2019-04-01
  ref <313>: RELEVANT RESIDUES IN SEQ ID NO: (1)..(1519)
ttttaaattgagagtttgatcctggctcaggacgaacgctggcggcgtgcttaacacatgcaagtcgagcgatgaaatcccttcggggatggattagcggcggacgggtgagtaacacgtgggcaacctgcctcaaagtgggggatagccttccgaaaggaagattaataccgcataacattagtatttcacatgaagtactaattaaaggagtgatccgctttgagatgggcccgcgggcgcattagctagttggtgaggtaacggctcaccaaggccacgatgcgtagccgacctgagagggtgatcggccacattggaactgagacacggtccagactcctacgggaggcagcagtggggaatattgcacaatgggcgaaagcctgatgcagcaacgccgcgtgagtgatgaaggccttcgggttgtaaagctctgtctttggggacgataatgacggtacccaaggaggaagccacggctaactacgtgccagcagccgcggtaatacgtaggtggcgagcgttgtccggatttactgggcgtaaaggatgcgtaggcggatgtttaagtcagatgtgaaaatcccgagcttaacttgggaactgcatttgaaactggatatctagagtgcgggagaggagaatggaattcctagtgtagcggtgaaatgcgtagagattaggaagaacaccagtggcgaaggcgattctctggaccgtaactgacgctgaggcatgaaagcgtgggtagcaaacaggattagataccctggtagtccacgccgtaaacgatgaatactaggtgtaggaggtatcgactccttctgtgccgcagctaacgcaataagtattccgcctgggaagtacgatcgcaagattaaaactcaaaggaattgacgggggcccgcacaagcagcggagcatgtggtttaattcgaagcaacgcgaagaaccttacctagacttgacatcccctgaattacctgtaatgagggaagcccttcggggcagggagacaggtggtgcatggttgtcgtcagctcgtgtcgtgagatgttaggttaagtcctgcaacgagcgcaacccttatcattagttgctaccattaagttgagcactctagtgagactgcccgggttaaccgggaggaaggtggggatgacgtcaaatcatcatgccccttatgtctagggctacacacgtgctacaatggtgagtacagaaagatgcaagaccgcgaggtggagcaaaacttttaaaactcatctcagttcggattgtaggctgaaactcgcctacatgaagctggagttgctagtaatcgcgaatcagcatgtcgcggtgaatacgttcccgggccttgtacacaccgcccgtcacaccatgagagctggcaacacccgaagtccgtgaggtaaccgtaaggagccagcggccgaaggtggggttagtaattggggtgaagtcgtaacaaggtagccgtaggagaacctgcggctggatcacctcctttcta

SEQ ID NO: 2785 - DNA, 1542 bp, Clostridium sp. 12 A
  ref <308>: DATABASE ACCESSION NUMBER: NCBI ACCESSION: NZ_JAGI01000002.1
  ref <309>: DATABASE ENTRY DATE: 2019-04-01
  ref <313>: RELEVANT RESIDUES IN SEQ ID NO: (1)..(1542)
tttgatttgagagttcgatcctggctcaggatgaacgctggcggcgtgcttaacacatgcaagtcgagcgaagcattttaaaggaagttttcggatggaatttagaatgacttagcggcggacgggtgagtaacgcgtgggtaacctgcctcatacagggggataacagttagaaatgactgctaataccgcataagcgcacagtgctgcatagtacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgtctcgtaacggagacctcccttcggggcattccagacaggtggtgcatggttgtcgtcagctcgtgtcgtgagatgttgggttaagtcccgcaacgagcgcaacccttatccttagtagccagcacgtaatggtgggcactctggggagactgccagggataacctggaggaaggtggggatgacgtcaaatcatcatgccccttatgatttgggctacacacgtgctacaatggcgtaaacaaagggaagcaaaggagcgatctggagcaaatcccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 2786 - DNA, 1512 bp, Clostridium sp. 1 1 41A1FAA
  ref <308>: DATABASE ACCESSION NUMBER: NCBI ACCESSION: NZ_KQ235833.1
  ref <309>: DATABASE ENTRY DATE: 2019-04-01
  ref <313>: RELEVANT RESIDUES IN SEQ ID NO: (1)..(1512)
ttttatttgagagtttgatcctggctcaggatgaacgctggcggcgtgcctaacacatgcaagtcgagcgatcttcttcggaagagagcggcggacgggtgagtaacgcgtgggtaacctgccctgtacacacggataacataccgaaaggtatgctaatacgggataacataagaaattcgcatgtttttcttatcaaagctccggcggtacaggatggacccgcgtctgattagctagttggtgaggtaacggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaatacgtagggggctagcgttatccggatttactgggcgtaaagggtgcgtaggcggtcttttaagtcaggagtgaaaggctacggctcaaccgtagtaagctcttgaaactggaggacttgagtgcaggagaggagagtggaattcctagtgtagcggtgaaatgcgtagatattaggaggaacaccagtagcgaaggcggctctctggactgtaactgacgctgaggcacgaaagcgtggggagcaaacaggattagataccctggtagtccacgccgtaaacgatgagtactagctgtcggaggttacccccttcggtggcgcagctaacgcattaagtactccgcctggggagtacgctcgcaagagtgaaactcaaaggaattgacggggacccgcacaagtagcggagcatgtggtttaattcgaagcaacgcgaagaaccttacctaagcttgacatccttttgaccgatgcctaatcgcatctttcccttcggggacagaagtgacaggtggtgcatggttgtcgtcagctcgtgtcgtgagatgttgggttaagtcccgcaacgagcgcaacccttgcctttagttgccatcattaagttgggcactctagagggactgccagggataacctggaggaaggtggggatgacgtcaaatcatcatgccccttatgcttagggctacacacgtgctacaatgggtggtacagagggcagcgaagtcgtgaggccaagctaatcccttaaagccattctcagttcggattgtaggctgaaactcgcctacatgaagctggagttactagtaatcgcagatcagaatgctgcggtgaatgcgttcccgggtcttgtacacaccgcccgtcacaccatgggagttgggggcgcccgaagccggctagctaaccttttggaagcggtcgtcgaaggtgaaaccaataactggggtgaagtcgtaacaaggtagccgtatcggaaggtgcggctggatcacctcctttctaagga

SEQ ID NO: 2787 - DNA, 1542 bp, Clostridium sp. ASBs410
  ref <308>: DATABASE ACCESSION NUMBER: NCBI ACCESSION: NZ_JFBV01000001.1
  ref <309>: DATABASE ENTRY DATE: 2019-04-01
  ref <313>: RELEVANT RESIDUES IN SEQ ID NO: (1)..(1542)
tttaatttgagagttcgatcctggctcaggatgaacgctggcggcgtgcttaacacatgcaagtcgagcgaagcgatttcaaggaagttttcggatggaattgaaattgacttagcggcggacgggtgagtaacgcgtgggtaacctgcctcatacagggggataacagtcggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggcgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgggatgtaacgatcccttccctacggggcattccagacaggtggtgcatggttgtcgtcagctcgtgtcgtgagatgttgggttaagtcccgcaacgagcgcaacccttatccttagtagccagcaagtgaagttgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 2788 - DNA, 1533 bp, Clostridium sp. ASF356
  ref <308>: DATABASE ACCESSION NUMBER: NCBI ACCESSION: NZ_KB822568.1
  ref <309>: DATABASE ENTRY DATE: 2019-04-01
  ref <313>: RELEVANT RESIDUES IN SEQ ID NO: (1)..(1533)
tttaatataagagtttgatcctggctcaggatgaacgctggcggcgtgcttaacacatgcaagtcgagcgaaaataattaggagcttgcttttaattattttagcggcggacgggtgagtaacgtgtgggcaacctgccttttactgtggaataatcactggaaacggtgactaataccgcatacggttcttaggaggcatcttctaagaaagaaaggatttattcggtaaaagatgggcccgcatctgattagctagttggtgagataatagcccaccaaggcaacgatcagtagccgacctgagagggtgaccggccacattgggactgagacacggcccaaactcctacgggaggcagcagtggggaatattgcacaatgggcgaaagcctgatgcagcaacgccgcgtgaaggaagacggttttcggattgtaaacttctatcaatagggaagaaagaaatgacggtacctaaataagaagccccggctaactacgtgccagcagccgcggtaatacgtagggggcaagcgttatccggaattactgggtgtaaagggagagtaggcggcaaggtaagcgatatgtgaaagccttaagcttaacttaaggatagcataacgaactatctagctagagtacaggagaggaaagcggaattcctagtgtagcggtgaaatgcgtagatattaggaagaacaccagtggcgaaggcggctttctggactgaaactgacgctgaggctcgaaagcgtggggagcgaacaggattagataccctggtagtccacgctgtaaacgatgagtgctaggtgtcggggaggaattcccggtgccggagcaaacgcaataagcactccacctggggagtacgaccgcaaggttgaaactcaaaggaattgacgggggcccgcacaagcggtggagcatgtggtttaattcgaagcaacgcgaagaaccttaccaaggcttgacatcctcttgacgaatgtagagatacattttttcttcggaacaagggagacaggtggtgcatggttgtcgtcagctcgtgtcgtgagatgttgggttaagtcccgcaacgagcgcaacccttatcttcagtagccagcaggtagagctgggcactctggagagactgccgtggataacacggaggaaggtggggatgacgtcaaatcatcatgccccttatgtcttgggcaacacacgtgctacaatggctagaaacaaagtgaagcgagacggtgacgttaagcaaagcacaaaaacctagtcccagttcggattgtagtctgcaactcgagtacatgaagctggaatcgctagtaatcgcaaatcagaatgttgcggtgaatacgttcccgggccttgtacacaccgcccgtcacaccatgggagttggaagcgcccgaagtcgatgacctaaccgcgagggaggagtcgccgaaggtgaagccagtgactggggtgaagtcgtaacaaggtagccgtatcggaaggtgcggctggatcacctcctttctaagga

SEQ ID NO: 2789 - DNA, 1531 bp, Clostridium sp. ATCC 29733
  ref <308>: DATABASE ACCESSION NUMBER: NCBI ACCESSION: NZ_KE993550.1
  ref <309>: DATABASE ENTRY DATE: 2019-04-01
  ref <313>: RELEVANT RESIDUES IN SEQ ID NO: (1)..(1531)
ttgataaagagtttgatcctggctcaggacgaacgctggcggcgcgcctaacacatgcaagtcgaacggacacatccgacggaatagcttgctaggaagatggatgttgttagtggcggacgggtgagtaacacgtgagcaacctgcctcggagtgggggacaacagttggaaacgactgctaataccgcatacggtggtcgggggacatcccctgaccaagaaaggatttatatccgctctgagatgggctcgcgtctgattagctagttggcggggtaacggcccaccaaggcaacgatcagtagccggactgagaggttgaacggccacattgggactgagacacggcccagactcctacgggaggcagcagtggggaatattgcacaatggggggaaccctgatgcagcgacgccgcgtgagggaagaaggttttcggattgtaaacctctgtcttgtgggacgataatgacggtaccacaggaggaagccatggctaactacgtgccagcagccgcggtaatacgtagatggcgagcgttgtccggaattactgggtgtaaagggagtgtaggcgggatcataagttgcgtgtgaaatgcaggggctcaacccctgaactgcgcgcaaaactgtggttcttgagtgaagtagaggcaggcggaattcccggtgtagcggtggaatgcgtagatatcgggaggaacaccagtggcgaaggcggcctgctgggcttttactgacgctgaggctcgaaagcatggggagcaaacaggattagataccctggtagtccatgccgtaaacgatgattactaggtgtggggggataaccccctccgtgccggagttaacacaataagtaatccacctggggagtacgaccgcaaggttgaaactcaaaggaattgacgggggcccgcacaagcagtggagtatgtggtttaattcgaagcaacgcgaaaaaccttaccaggtcttgacatctatcgctatcccaagagattgggagttcccttcggggacggtaagacaggtggtgcatggttgtcgtcagctcgtgtcgtgagatgttgggttaagtcccgcaacgagcgcaacccttactgttagttgctacgcaagagcactctaacgggactgccgttgacaaaacggaggaaggtggggatgacgtcaaatcatcatgccctttatgacctgggctacacacgtactacaatggccgcaaacaacgagcagcgaaaccgcgaggtggagcgaatctataaaagcggtctcagttcggattgcaggctgcaactcgcctgcatgaagtcggaattgctagtaatcgcggatcagcatgccgcggtgaatacgttcccgggccttgtacacaccgcccgtcacaccatgagagccggtaacacccgaagtcagtagtctaaccgcaagggggacgctgccgaaggtggggctggtgattggggtgaagtcgtaacaaggtagccgtatcggaaggtgcggctggatcacctcctttcta

SEQ ID NO: 2790 - DNA, 1217 bp, Clostridium sp. BL-8
  ref <308>: DATABASE ACCESSION NUMBER: NCBI ACCESSION: NZ_LZZL01000230.1
  ref <309>: DATABASE ENTRY DATE: 2019-04-01
  ref <313>: RELEVANT RESIDUES IN SEQ ID NO: (1)..(1217)
ttttaattgagagtttgatcctggctcaggacgaacgctggcggcgtgcttaacacatgcaagtcgagcgatgaagcttcttcgggagtggattagcggcggacgggtgagtaacacgtgggtaacctgcctcatagaggggaatagccttccgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtcttcagggacgataatgacggtacctgaggaggaagccacggctaactacgtgccagcagccgcggtaatacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacaggattagataccctggtagtccacgccgtaaacgatgaatactaggtgtgggggttgtcatgacctccgtgccgccgcaaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactcttaatcgaggaagcccttcggggcaggaagacaggtggtgcatggttgtcgtcagctcgtgtcgtgagatgttgggttaagtcccgcaacgagcgcaacccttattgttagttgctaccattaagttgagcactctagcgagactgcccgggttaaccgggaggaaggtggggatgacgtcaaatcatcatgccccttatgtctagggctacacacgtgctacaatggctgg

SEQ ID NO: 2791 - DNA, 1531 bp, Clostridium sp. Bc-iso-3
  ref <308>: DATABASE ACCESSION NUMBER: NCBI ACCESSION: NZ_LXSB01000001.1
  ref <309>: DATABASE ENTRY DATE: 2019-04-01
  ref <313>: RELEVANT RESIDUES IN SEQ ID NO: (1)..(1531)
tttttagagagtttgatcctggctcaggacgaacgctggcggcgtgcctaacacatgcaagtcgagcggagatatatagaaggtttaccggaaatatatcttagcggcggacgggtgagtaacgcgtgggcaacctgcctcatacagggggataacacagggaaacttgtgctaataccgcatgatatcattgtatggcatcatacgatgatcaaaggagcaatccggtatgagatgggcccgcgtccgattagctagttggtgaggtaaaggctcaccaaggcgacgatcggtagccgaactgagaggttgatcggccacattgggactgagacacggcccagactcctacgggaggcagcagtggggaatattgcgcaatgggggaaaccctgacgcagcaacgccgcgtgaaggaagaaggccttcgggttgtaaacttctttgattggggacgaagaaagtgactgtacccaaaaaacaagccacggctaactacgtgccagcagccgcggtaatacgtaggtggcaagcgttgtccggaattactgggtgtaaagggcgtgtaggcgggtgaccaagtcagatgtgaaattccggggcttaactccggcgctgcatctgaaactggacatcttgagtgctggagaggaaagcggaattcctagtgtagcggtgaaatgcgtagatattaggaggaacaccagtggcgaaggcggctttctggacagtaactgacgctgaggcgcgaaagcgtggggagcaaacaggattagataccctggtagtccacgccgtaaacgatggatactaggtgtaggaggtatcgaccccttctgtgccggagttaacacaataagtatcccacctggggagtacggccgcaaggttgaaactcaaaggaattgacgggggcccgcacaagcagtggagtatgtggtttaattcgaagcaacgcgaagaaccttaccagggcttgacatcccttgacgatcctagagataggatttctcttcggagcaaggagacaggtggtgcatggttgtcgtcagctcgtgtcgtgagatgttgggttaagtcccgcaacgagcgcaacccctgttgttagttgccatcattaagttgggcactctagcgagactgccggtgacaaatcggaggaaggtggggacgacgtcaaatcatcatgccccttatgtcctgggctacacacgtactacaatggctgttacagagggaagctaagccgcgaggtggagcaaacccccaaaggcagccccagttcagattgcaggctgaaactcgcctgcatgaagtcggaattgctagtaatggcaggtcagcatactgccgtgaatacgttcccgggccttgtacacaccgcccgtcacaccatgagagtctgcaacacccgaagtcagtagtctaaccgcaaggagggcgctgccgaaggtggggccgatgattggggtgaagtcgtaacaaggtagccgtatcggaaggtgcggctggatcacctcctttctaagga

SEQ ID NO: 2792 - DNA, 1468 bp, Clostridium sp. DSM 18688
  ref <308>: DATABASE ACCESSION NUMBER: NCBI ACCESSION: NZ_MRAD01000032.1
  ref <309>: DATABASE ENTRY DATE: 2019-04-01
  ref <313>: RELEVANT RESIDUES IN SEQ ID NO: (1)..(1468)
ttaacacatgcaagtcgagcgatgaagcttccttcgggaagtggattagcggcggacgggtgagtaacacgtgggtaacctacctcaaagtgggggatagcctcccgaaagggagattaataccgcataatataagaaaatcgcatgattatcttatcaaagatttatcgctttgagatggacccgcggcgcattagctagttggtggggtaacggcctaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgatgaaggtcttcggattgtaaagccctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccctctgtgccgcagttaacacaataagtatcccgcctggggagtacggtcgcaagattaaaactcaaaggaattgacgggggcccgcacaagcagcggagcatgtggtttaattcgaagcaacgcgaagaaccttacctggacttgacatcccttgcatagcctagagataggtgaagcccttcggggcaaggagacaggtggtgcatggttgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagaggcaagaccgtgaggtggagcaaaacttataaagcctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggcaaccgtaaggagccagcggccgaaggtgggattagtgattggggtgaagtcgtaacaaggtagccgtaggagaacctgcggctggatcacctcctttcta

SEQ ID NO: 2793 - DNA, 1531 bp, Clostridium sp. DSM 4029; identical to SEQ ID NO: 2789
  ref <308>: DATABASE ACCESSION NUMBER: NCBI ACCESSION: NZ_FQVY01000009.1
  ref <309>: DATABASE ENTRY DATE: 2019-04-01
  ref <313>: RELEVANT RESIDUES IN SEQ ID NO: (1)..(1531)

SEQ ID NO: 2794 - DNA, 1541 bp, Clostridium sp. FS41
  ref <308>: DATABASE ACCESSION NUMBER: NCBI ACCESSION: NZ_JYHN01000039.1
  ref <309>: DATABASE ENTRY DATE: 2019-04-01
  ref <313>: RELEVANT RESIDUES IN SEQ ID NO: (1)..(1541)
ttaatttgagagtttgatcctggctcaggatgaacgctggcggcgtgcctaacacatgcaagtcgaacgaagcaatcagaatgaaattttcggatggatttctggttgactgagtggcggacgggtgagtaacgcgtggataacctgcctcacactgggggataacagttagaaatggctgctaataccgcataagcgcacagtaccgcatggtacggtgtgaaaaactccggtggtgtgagatggatccgcgtctgattagttagttggcggggtaacggcccaccaagacagcgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaactgacggtacctgactaagaagccccggctaactacgtgccagcagccgcggtaatacgtagggggcaagcgttatccggatttactgggtgtaaagggagcgtagacggcgaagcaagtctggagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcaataagcattccacctggggagtacgttcgcaagaatgaaactcaaaggaattgacggggacccgcacaagcggtggagcatgtggtttaattcgaagcaacgcgaagaaccttaccaagtcttgacatccccctgaccggtcagtaaagtgacctttccttcgggacaggggagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcgaccctgcgaaggcaagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaa

SEQ ID NO: 2795 - DNA, 1407 bp, Clostridium sp. HMSC19A10
  ref <308>: DATABASE ACCESSION NUMBER: NCBI ACCESSION: NZ_KV823354.1
  ref <309>: DATABASE ENTRY DATE: 2019-04-01
  ref <313>: RELEVANT RESIDUES IN SEQ ID NO: (1)..(1407)
acgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatgga

SEQ ID NO: 2796 - DNA, 1170 bp, Clostridium sp. IBUN125C
  ref <308>: DATABASE ACCESSION NUMBER: NCBI ACCESSION: NZ_JZWF01000047.1
  ref <309>: DATABASE ENTRY DATE: 2019-04-01
  ref <313>: RELEVANT RESIDUES IN SEQ ID NO: (1)..(1170)
gcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatgga

SEQ ID NO: 2797 - DNA, 1522 bp, Clostridium sp. IBUN13A
  ref <308>: DATABASE ACCESSION NUMBER: NCBI ACCESSION: NZ_JZWG01000013.1
  ref <309>: DATABASE ENTRY DATE: 2019-04-01
  ref <313>: RELEVANT RESIDUES IN SEQ ID NO: (1)..(1522)
tttttattgagagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatgga

SEQ ID NO: 2798 - DNA, 1296 bp, Clostridium sp. IBUN22A
  ref <308>: DATABASE ACCESSION NUMBER: NCBI ACCESSION: NZ_JZWE01000039.1
  ref <309>: DATABASE ENTRY DATE: 2019-04-01
  ref <313>: RELEVANT RESIDUES IN SEQ ID NO: (1)..(1296)
atggacccgcgtcgcattagctagttggtgaggtaacggctcaccaaggcgacgatgcgtagccgacctgagagggtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatgga

SEQ ID NO: 2799 - DNA, 1221 bp, Clostridium sp. IBUN62F
  ref <308>: DATABASE ACCESSION NUMBER: NCBI ACCESSION: NZ_JZWH01000065.1
  ref <309>: DATABASE ENTRY DATE: 2019-04-01
  ref <313>: RELEVANT RESIDUES IN SEQ ID NO: (1)..(1221)
gtgatcggccacattgggactgagacacggcccagactcctacgggaggcagcagtggggaatattgcacaatgggggaaaccctgatgcagcaacgccgcgtgagtgatgacggtcttcggattgtaaagctctgtctttagggacgataatgacggtacctaaggaggaagccacggctaactacgtgccagcagccgcggtaatacgtaggtggcaagcgttgtccggatttactgggcgtaaagggagcgtaggtggatatttaagtgggatgtgaaatacccgggcttaacctgggtgctgcattccaaactggatatctagagtgcaggagaggaaaggagaattcctagtgtagcggtgaaatgcgtagagattaggaagaataccagtggcgaaggcgcctttctggactgtaactgacactgaggctcgaaagcgtggggagcaaacaggattagataccctggtagtccacgccgtaaacgatgaatactaggtgtaggggttgtcatgacctctgtgccgccgctaacgcattaagtattccgcctggggagtacggtcgcaagattaaaactcaaaggaattgacgggggcccgcacaagcagcggagcatgtggtttaattcgaagcaacgcgaagaaccttacctagacttgacatctcctgaattactctgtaatggaggaagccacttcggtggcaggaagacaggtggtgcatggttgtcgtcagctcgtgtcgtgagatgttgggttaagtcccgcaacgagcgcaacccttattgttagttgctaccatttagttgagcactctagcgagactgcccgggttaaccgggaggaaggtggggatgacgtcaaatcatcatgccccttatgtctagggctacacacgtgctacaatggtcggtacaatgagatgcaacctcgcgagagtgagcaaaactataaaaccgatctcagttcggattgtaggctgaaactcgcctacatgaagctggagttgctagtaatcgcgaatcagaatgtcgcggtgaatacgttcccgggccttgtacacaccgcccgtcacaccatgagagttggcaatacccaaagttcgtgagctaaccgcaaggaggcagcgacctaaggtagggtcagcgattggggtgaagtcgtaacaaggtagccgtaggagaacctgcggctggatcacctcctttctatgga

SEQ ID NO: 2800 - DNA, 1182 bp, Clostridium sp. K25
  ref <308>: DATABASE ACCESSION NUMBER: NCBI ACCESSION: NZ_JENU01000023.1
  ref <309>: DATABASE ENTRY DATE: 2019-04-01
  ref <313>: RELEVANT RESIDUES IN SEQ ID NO: (1)..(1182)
gagtggattagcggcggacgggtgagtaacacgtgggtaacctgcctcaaagagggggatagcctcccgaaagggagattaataccgcataacattattttatggcatcataaaataatcaaaggagcaatccgctttgagatggacccgcggcgcattagctagttggtgaggtaagggctcaccaaggcgacgatgcgtagccgacctgagagggggatcggccacattggaactgagacacggtccagactcctacgggaggcagcagtggggaatattgcgcaatgggggaaaccctgacgcagcaacgccgcgtgagtgatgaaggttttcggatcgtaaaactctgtctttagggacgataatgacggtacctaaggaggaagccacggctaactacgtgccagcagccgcggtaatacgtaggtggcaagcgttgtccggatttactgggcgtaaagagtatgtaggtgggtgcttaagtcagatgtgaaattcccgggcttaacctgggcgctgcatttgaaactgggcatctagagtgcaggagaggaaagtggaattcctagtgtagcggtgaaatgcgtagagattaggaagaacaccagtggcgaaggcgactttctggactgtaactgacactgagatacgaaagcgtgggtagcaaacaggattagataccctggtagtccacgccgtaaacgatgaatactaggtgtcggggggtaccaccctcggtgccgcagcaaacgcattaagtattccgcctggggagtacggtcgcaagattaaaactcaaaggaattgacggggacccgcacaagcagcggagcatgtggtttaattcgaagcaacgcgaagaaccttacctagacttgacatctcctgaattactcttaatcgaggaagtcccttcggggacaggaagacaggtggtgcatggttgtcgtcagctcgtgtcgtgagatgttgggttaagtcccgcaacgagcgcaacccttattgttagttgctactattaagttaagcactctaacgagactgccgcggttaacgtggaggaaggtggggatgacgtcaaatcatcatgccccttatgtctagggctacacacgtgctacaatggctggtacaacgagcagcaaacccgcgagggggagcaaaacttgaaagccagtc

SEQ ID NO: 2801 - DNA, 1540 bp, Clostridium sp. KLE 1755
  ref <308>: DATABASE ACCESSION NUMBER: NCBI ACCESSION: NZ_KE992700.1
  ref <309>: DATABASE ENTRY DATE: 2019-04-01
  ref <313>: RELEVANT RESIDUES IN SEQ ID NO: (1)..(1540)
ttaaacaagagagtttgatcctggctcaggatgaacgctggcggcgtgcctaacacatgcaagtcgaacggagttatgcagaggaagttttcggatggaatcggcgtaacttagtggcggacgggtgagtaacgcgtgggaaacctgccctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatgacaagccagatgtgaaaacccagggctcaaccctgggactgcatttggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatcccaatgacgtgcccgtaacggggcattctcttcggagcattggagacaggtggtgcatggttgtcgtcagctcgtgtcgtgagatgttgggttaagtcccgcaacgagcgcaacccttatccttagtagccagcaggtaaagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccgtaaggaaggagcagtcgaaggcaggtctaataactggggtgaagtcgtaacaaggtagccgtatcggaaggtgcggctggatcacctcctttctaagg

SEQ ID NO: 2802 - DNA, 1562 bp, Clostridium sp. KNHs205
  ref <308>: DATABASE ACCESSION NUMBER: NCBI ACCESSION: NZ_JNLE01000003.1
  ref <309>: DATABASE ENTRY DATE: 2019-04-01
  ref <313>: RELEVANT RESIDUES IN SEQ ID NO: (1)..(1562)
tttaatttgagagtttgatcctggctcaggatgaacgctggcggcgtgcttaacacatgcaagtcgaacggagtttataagcggaagtcttcggatggaagcttatgaacttagtggcggacgggtgagtaacgcgtgggtaacctgccttacacagggggataacagccggaaacggctgctaataccgcataagcgcacagtgctgcatggtaccgtgtgaaaagattttatcggtgtaagatggacccgcgtctgattagctagttggtggggtaacggcctaccaaggcaacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggacgaagtggagttcgtgagaactcctttgacggtacctgactaagaagccccggctaactacgtgccagcagccgcggtaatacgtagggggcaagcgttatccggatttactgggtgtaaagggagcgtagacggtgatgtaagtcagatgtgaaagcccggggctcaaccccgggactgcatttgaaactatgttgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttgggggtcaaaagaccttcggtgccgtcgcaaacgcattaagtattccacctggggagtacgttcgcaagaatgaaactcaaaggaattgacggggacccgcacaagcggtggagcatgtggtttaattcgaagcaacgcgaagaaccttaccaggtcttgacatccctctgactggatcttaaccggtcctttccttcgggacagaggagacaggtggtgcatggttgtcgtcagctcgtgtcgtgagatgttgggttaagtcccgcaacgagcgcaacccttatccttagtagccagcagttcggctgggcactctagggagactgccagggataacctggaggaaggcggggatgacgtcaaatcatcatgccccttatgatctgggctacacacgtgctacaatggtgactacaaagggaagcagcctcgtgagagtgagcaaatcccaaaaaggtcatctcagttcggattgtagtctgcaactcgactacatgaagctggaatcgctagtaatcgcgaatcagaatgtcgcggtgaatacgttcccgggtcttgtacacaccgcccgtcacaccatgggagttggaaatgcccgaagtctgtgacccaaccgtaaggagggagcagccgaaggcaggttcaataactggggtgaagtcgtaacaaggtagccgtatcggaaggtgcggctggatcacctcctttctaaggaa

SEQ ID NO: 2803 - DNA, 1516 bp, Clostridium sp. KNHs214
  ref <308>: DATABASE ACCESSION NUMBER: NCBI ACCESSION: NZ_JQMW01000011.1
  ref <309>: DATABASE ENTRY DATE: 2019-04-01
  ref <313>: RELEVANT RESIDUES IN SEQ ID NO: (1)..(1516)
tttaaattgagagtttgatcctggctcaggacgaacgctggcggcgtgcctaacacatgcaagtcgagcgatgaaatcccttcggggatggattagcggcggacgggtgagtaacacgtgggcaacctgcctcaaagaggggaatagcctcccgaaagggagattaataccgcataaaattatggaatcgcatggttctgtaatcaaaggagcaatccgctttgagatgggcccgcggcgcattagctagttggtaaggtaaaggcttaccaaggcgacgatgcgtagccgacctgagagggtgatcggccacattggaactgagacacggtccagactcctacgggaggcagcagtggggaatattgcgcaatgggggaaaccctgacgcagcaacgccgcgtgagtgatgaaggccttagggttgtaaagctctgttatctgggacgataatgacggtaccagaggaggaagccacggctaactacgtgccagcagccgcggtaatacgtaggtggcgagcgttgtccggatttactgggcgtaaagagtgcgtaggcggatgtttaagtgagatgtgaaatacccgagctcaacttgggtgctgcatttcaaactgggcatctagagtgcaggagaggaaagcggaattcctagtgtagcggtgaaatgcgtagagattaggaagaacaccagtggcgaaggcggctttctggactgtaactgacgctgaggcacgaaagcgtggggagcaaacaggattagataccctggtagtccacgccgtaaacgatgggtactaggtgtcgggggtccaacctcggtgccgcagtaaacacattaagtaccccgcctggggagtacggtcgcaagattaaaactcaaaggaattgacgggggcccgcacaagcagcggagcatgtggtttaattcgaagcaacgcgaagaaccttacctagacttgacatcccaagaatactgtggaaacacggtagtgcccttcggggaacttggagacaggtggtgcatggttgtcgtcagctcgtgtcgtgagatgttgggttaagtcccgcaacgagcgcaacccctattgttagttgctaccattaagttgagcactctagcaagactgcctgggttaaccaggaggaaggtggggatgacgtcaaatcatcatgccccttatgtctagggctacacacgtgctacaatggtcggtacaaagagacgcaagaccgtgaggtggagcaaatctcaaaaaccgatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggtaaccgtaaggagccagcggccgaaggtgggattagtgattggggtgaagtcgtaacaaggtagccgtaggagaacctgcggctggatcacctcctttcta

SEQ ID NO: 2804 - DNA, 1529 bp, Clostridium sp. L2-50
  ref <308>: DATABASE ACCESSION NUMBER: NCBI ACCESSION: NZ_DS480312.1
  ref <309>: DATABASE ENTRY DATE: 2019-04-01
  ref <313>: RELEVANT RESIDUES IN SEQ ID NO: (1)..(1529)
tttttaatgagagtttgatcctggctcaggatgaacgctggcggcgtgcttaacacatgcaagtcgaacgagagaagatcggtgcttgcactgatccgatcgagtggcggacgggtgagtaacgcgtgggtaacctgcctcatacaggggaataacagttggaaacggctgctaaaaccgcataagcgcacagtatcgcatgatacagtgtgaaaaactccggtggtatgagatggacccgcgtctgattagctagttggtgaggtaacggcccaccaaggcaacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggtgagacaagtctgaagtgaaaatccggggcttaaccccggaactgctttggaaactgcctgactagagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgtcggggcccaaagggcttcggtgccgcagccaacgcaataagtattccacctggggagtacgttcgcaagaatgaaactcaaaggaattgacggggacccgcacaagcggtggagcatgtggtttaattcgaagcaacgcgaagaaccttaccaagtcttgacatcctgctgaccgttccttaatcggaattttccttcgggacagcagagacaggtggtgcatggttgtcgtcagctcgtgtcgtgagatgttgggttaagtcccgcaacgagcgcaacccctatttccagtagccagcagtcagatgggcactctggagagactgccggggataacccggaggaaggtggggatgacgtcaaatcatcatgccccttatgatttgggctacacacgtgctacaatggcagttacaaagagaagcgaaactgtgaagtggagcaaacctcaaaaaggctgtctcagttcggattgtagtctgcaactcgactacatgaagctggaatcgctagtaatcgcagatcagaatgctgcggtgaatacgttcccgggtcttgtacacaccgcccgtcacaccatgggagtcggaaacgcccgaagtcagtgacccaaccgcaaggagggagctgccgaaggcaggttcgataactggggtgaagtcgtaacaaggtagccgtatcggaaggtgcggctggatcacctcctttctaaggaa

SEQ ID NO: 2805 - DNA, 1518 bp, Clostridium sp. L74
  ref <308>: DATABASE ACCESSION NUMBER: NCBI ACCESSION: NZ_LITJ01000014.1
  ref <309>: DATABASE ENTRY DATE: 2019-04-01
  ref <313>: RELEVANT RESIDUES IN SEQ ID NO: (1)..(1518)
ttttaaatttagagtttgatcctggctcaggacgaacgctggcggcgtgcttaacacatgcaagtcgagcgatgaagcttccttcgggaagtggattagcggcggacgggtgagtaacacgtgggtaacctgcctcaaagtgggggatagccttccgaaaggaagattaataccgcataacataagataatcgcatgattttcttatcaaagatttattgctttgagatggacccgcggcgcattagctagttggtaaggtaatggcttaccaaggcaacgatgcgtagccgacctgagagggtgatcggccacattggaactgagacacggtccagactcctacgggaggcagcagtggggaatattgcgcaatgggggaaaccctgacgcagcaacgccgcgtgggtgatgaaggtcttcggattgtaaagccctgttttctgggacgataatgacggtaccagaggaggaagccacggctaactacgtgccagcagccgcggtaatacgtaggtggcgagcgttgtccggatttactgggcgtaaagggtgcgtaggcggatgtttaagtgggatgtgaaatccccgggcttaacctgggggctgcattccaaactggatatctagagtgcaggagaggaaagcggaattcctagtgtagcggtgaaatgcgtagagattaggaagaacaccagtggcgaaggcggctttctggactgtaactgacgctgaggcacgaaagcgtgggtagcaaacaggattagataccctggtagtccacgccgtaaacgatggatactaggtgtagggggtatcaactccctctgtgccgcagttaacacaataagtatcccgcctggggagtacggtcgcaagattaaaactcaaaggaattgacgggggcccgcacaagcagcggagcatgtggtttaattcgaagcaacgcgaagaaccttacctggacttgacatcccttgcatagcctagagataggtgaagcccttcggggcaaggagacaggtggtgcatggttgtcgtcagctcgtgtcgtgagatgttaggttaagtcctgcaacgagcgcaacccttgttattagttgctaccattaagttgagcactctaatgagactgcctgggtaaccaggaggaaggtggggatgacgtcaaatcatcatgccccttatgtccagggctacacacgtgctacaatggtaggtacaataagacgcaagaccgtgaggtggagcaaaacttataaaacctatctcagttcggattgtaggctgcaactcgcctacatgaagctggagttgctagtaatcgcgaatcagaatgtcgcggtgaatacgttcccgggccttgtacacaccgcccgtcacaccatgagagctggtaacacccgaagtccgtgaggcaaccgtaaggagccagcggccgaaggtgggattagtgattggggtgaagtcgtaacaaggtagccgtaggagaacctgcggctggatcacctcctttcta

SEQ ID NO: 2806 - DNA, 1525 bp, Clostridium sp. MSTE9
  ref <308>: DATABASE ACCESSION NUMBER: NCBI ACCESSION: NZ_AKFU01000025.1
  ref <309>: DATABASE ENTRY DATE: 2019-04-01
  ref <313>: RELEVANT RESIDUES IN SEQ ID NO: (1)..(1525)
ttttagagagtttgatcctggctcaggacgaacgctggcggcatgcctaacacatgcaagtcgaacggagtaagagagaagcttgcttagctcttacctagtggcggacgggtgagtaacgcgtgagtaacctgcctttcagagggggataacgttctgaaaagaacgctaataccgcatgatatattggggtcgcatggccttggtatcaaaggagcaatccgctgaaagatggactcgcgtccgattagccagttggcggggtaaaggcccaccaaagcgacgatcggtagccgggttgagagactgaacggccacattgggactgagacacggcccagactcctacgggaggcagcagtgggggatattgcacaatggaggaaactctgatgcagcaatgccgcgtgagggaagacggtcttcggattgtaaacctctgtccttggtgaagataatgacggtagccaaggaggaagctccggctaactacgtgccagcagccgcggtaatacgtagggagcaagcgttgtccggatttactgggtgtaaagggtgcgtaggcggctttttaagtcgggcgtgaaagctgtgggcttaacccacaaattgcgttcgaaactggaaggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaggcagagatgcattaggtgcccttcggggaaagttgagacaggtggtgcatggttgtcgtcagctcgtgtcgtgagatgttgggttaagtcccgcaacgagcgcaacccttgtgattagttgctacgcaagagcactctaatcagactgccgttgacaaaacggaggaaggtggggacgacgtcaaatcatcatgccccttatgacctgggctacacacgtactacaatggtcgctaacagagggaagccaagccgcgaggtggagcaaacccccaaaagcgatctcagttcggattgtaggctgcaacccgcctacatgaagttggaattgctagtaatcgcggatcagcatgccgcggtgaatacgttcccgggccttgtacacaccgcccgtcacaccatgggagccggtaatacccgaagccaatagtctaaccgcaagggggacgttgtcgaaggtaggattggcgactggggtgaagtcgtaacaaggtagccgtatcggaaggtgcggctggatcacctcctttctatgga

SEQ ID NO: 2807 - DNA, 1543 bp, Clostridium sp. Marseille-P2415
  ref <308>: DATABASE ACCESSION NUMBER: NCBI ACCESSION: NZ_LT732526.1
  ref <309>: DATABASE ENTRY DATE: 2019-04-01
  ref <313>: RELEVANT RESIDUES IN SEQ ID NO: (1)..(1543)
ttataatatgagagttcgatcctggctcaggatgaacgctggcggcgtgcttaacacatgcaagtcgagcgaagcaatttgaatgaagttttcggatggattttaaattgactgagcggcggacgggtgagtaacgcgtgggtaacctgcctcatacagggggataacagttggaaacgactgctaataccgcataagcgcacagtgctgcatggcacggtgcgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggcgctgcaagtctggagtgaaagcccggggctcaaccccgggactgctttggaaactgtggagctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcaggtaaagctgggcactctgaggagactgccagggataacctggaggaaggtggggatgacgtcaaatcatcatgccccttatgatttgggctacacacgtgctacaatggcgtaaacaaagggaggcgaagccgcgaggtggagcaaatcccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaa

SEQ ID NO: 2808 - DNA, 1544 bp, Clostridium sp. Marseille-P2538
  ref <308>: DATABASE ACCESSION NUMBER: NCBI ACCESSION: NZ_FLKL01000002.1
  ref <309>: DATABASE ENTRY DATE: 2019-04-01
  ref <313>: RELEVANT RESIDUES IN SEQ ID NO: (1)..(1544)
ttttaagacgagagtttgatcctggctcaggatgaacgctggcggcgtgcttaacacatgcaagtcgagcgaagcgccttatacagattccttcgggatgaaggatttggcgactgagcggcggacgggtgagtaacgcgtgggcaacctgcctcacacagggggataacagctagaaatggctgctaataccgcataaggccgcggcaccgcatggtgcggcggcagaagctccggcggtgtgagatgggcccgcgtctgattaggtagttggtgcggtaacggcgcaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcagggcaagtctggagtgaaagcccggggctcaaccccgggactgctttggaaactgccatgctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgattactaggtgtcgggaagcaaagcttctcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctggtcttgacatccccctggccggacagtaacgtgtcctttccttcgggacaggggagacaggtggtgcatggttgtcgtcagctcgtgtcgtgagatgttgggttaagtcccgcaacgagcgcaacccctatctttagtagccagcattccggatgggcactctagagagactgccagggacaacctggaggaaggtggggatgacgtcaaatcatcatgccccttatgatcagggctacacacgtgctacaatggcgtaaacaaagggaagcgaccctgcgaaggcaagcgaatcccaaaaataacgtcccagttcggattgtagtctgcaactcgactacatgaagctggaatcgctagtaatcgcgaatcagaatgtcgcggtgaatacgttcccgggtcttgtacacaccgcccgtcacaccatgggagtcggtaacgcccgaagtcagtgacccaaccgcaaggagggagctgccgaaggtgggaccgataactggggtgaagtcgtaacaaggtagccgtatcggaaggtgcggctggatcacctcctttctaaggaa

SEQ ID NO: 2809 - DNA, 1538 bp, Clostridium sp. Marseille-P299
  ref <308>: DATABASE ACCESSION NUMBER: NCBI ACCESSION: NZ_FJVE01000005.1
  ref <309>: DATABASE ENTRY DATE: 2019-04-01
  ref <313>: RELEVANT RESIDUES IN SEQ ID NO: (1)..(1538)
tttttttgagagtttgatcctggctcaggatgaacgctggcggcgtgcttaacacatgcaagtcgaacgaagcacttaagcggatcccttcggggtgaagcttaagtgacttagtggcggacgggtgagtaacgcgtgggtaacctgcctcatacagggggataacagttggaaacgactgctaacaccgcataaaacagtagtgccgcatgacacaactgtcaaatatttataggtatgagatgggcccgcgtctgattagctagttggtggggtaaaagcctaccaaggcgacgatcagtagccggcttgagagagtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagataatgacagtacctgactaagaagccccggctaactacgtgccagcagccgcggtaatacgtagggggcaagcgttatccggatttactgggtgtaaagggagcgtaggtggctaggtaagtcaggtgtgaaagcccggggctcaaccccgggattgcacttgaaactacttagctagagtgcaggagaggtaagtggaattcctagtgtagcggtgaaatgcgtagatattaggaggaacaccagtggcgaaggcggcttactggactgtaactgacactgaggctcgaaagcgtggggagcaaacaggattagataccctggtagtccacgccgtaaacgatgaatactaggtgtcggggctcataagagcttcggtgccgcagctaacgcaataagtattccacctggggagtacgttcgcaagaatgaaactcaaaggaattgacggggacccgcacaagcggtggagcatgtggtttaattcgaagcaacgcgaagaaccttaccaggtcttgacatccctttgacagccgagtaacgtcggttttccttcgggacaaaggtgacaggtggtgcatggttgtcgtcagctcgtgtcgtgagatgttgggttaagtcccgcaacgagcgcaacccctatctttagtagccagcagttcggctgggcactctagagagactgccagggataacctggaggaaggcggggatgacgtcaaatcatcatgccccttatgatctgggctacacacgtgctacaatggtgactacaaagggaagcaaacctgcgagggggagcaaatcccaaaaaggtcatcccagttcggattgtactctgcaactcgagtacatgaagctggaatcgctagtaatcgcgaatcagaatgtcgcggtgaatacgttcccgggtcttgtacacaccgcccgtcacaccatgggagtcggatatgcccgaagtcagtgacccaaccgtaaggagggagctgccgaaggtggagccgataactggggtgaagtcgtaacaaggtagccgtatcggaaggtgcggctggatcacctcctttctaag

SEQ ID NO: 2810 - DNA, 1541 bp, Clostridium sp. Marseille-P3244
  ref <308>: DATABASE ACCESSION NUMBER: NCBI ACCESSION: NZ_LT635548.1
  ref <309>: DATABASE ENTRY DATE: 2019-04-01
  ref <313>: RELEVANT RESIDUES IN SEQ ID NO: (1)..(1541)
tttaacgagagtttgatcctggctcaggatgaacgctggcggcgtgcctaacacatgcaagtcgagcgaagcactttacttagatttcttcggaatgacgagttttgtgactgagcggcggacgggtgagtaacgcgtgggtaacctgcctcatacagggggataacagttagaaatgactgctaataccgcataagaccacagcttcgcatggagcggtggtaaaaactccggtggtatgagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaactgacggtacctgactaagaagcaccggctaaatacgtgccagcagccgcggtaatacgtatggtgcaagcgttatccggatttactgggtgtaaagggagcgtagacggataggcaagtctggagtgaaagcccggggctcaaccccgggactgctttggaaactgtttatctagagtgctggagaggtaagtggaattcctagtgtagcggtgaaatgcgtagatattaggaggaacaccagtggcgaaggcggcttactggacagtaactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgcccttgacatccggatgaccggtgggtaatgccaccctctcttcggagcatccgagacaggtggtgcatggttgtcgtcagctcgtgtcgtgagatgttgggttaagtcccgcaacgagcgcaacccttatctttagtagccagcattcaggatgggcactctagagagactgccagggataacctggaggaaggtggggatgacgtcaaatcatcatgccccttatgggcagggctacacacgtgctacaatggcgtaaacaaagggaagcgagtccgtgaggataagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 2811 - DNA, 1541 bp, Clostridium sp. SS2 1
  ref <308>: DATABASE ACCESSION NUMBER: NCBI ACCESSION: NZ_DS547028.1
  ref <309>: DATABASE ENTRY DATE: 2019-04-01
  ref <313>: RELEVANT RESIDUES IN SEQ ID NO: (1)..(1541)
gaacatgagagtttgatcctggctcaggatgaacgctggcggcgtgcttaacacatgcaagtcgaacgaaacaccttatttgattttcttcggaactgaagatttggtgattgagtggcggacgggtgagtaacgcgtgggtaacctgccctgtacagggggataacagtcagaaatgactgctaataccgcataagaccacagcaccgcatggtgcaggggtaaaaactccggtggtacaggatggacccgcgtctgattagctggttggtgaggtaacggctcaccaaggcgacgatcagtagccggcttgagagagtgaacggccacattgggactgagacacggcccaaactcctacgggaggcagcagtggggaatattgcacaatgggggaaaccctgatgcagcgacgccgcgtgagtgaagaagtatctcggtatgtaaagctctatcagcagggaagaaaatgacggtacctgactaagaagccccggctaactacgtgccagcagccgcggtaatacgtagggggcaagcgttatccggaattactgggtgtaaagggtgcgtaggtggtatggcaagtcagaagtgaaaacccagggcttaactctgggactgcttttgaaactgtcagactagagtgcaggagaggtaagcggaattcctagtgtagcggtgaaatgcgtagatattaggaggaacatcagtggcgaaggcggcttactggactgaaactgacactgaggcacgaaagcgtggggagcaaacaggattagataccctggtagtccacgccgtaaacgatgaatactaggtgtcggggccgtagaggcttcggtgccgcagccaacgcagtaagtattccacctggggagtacgttcgcaagaatgaaactcaaaggaattgacggggacccgcacaagcggtggagcatgtggtttaattcgaagcaacgcgaagaaccttacctggtcttgacatccttctgaccggtccttaaccggacctttccttcgggacaggagtgacaggtggtgcatggttgtcgtcagctcgtgtcgtgagatgttgggttaagtcccgcaacgagcgcaacccctatctttagtagccagcatataaggtgggcactctagagagactgccagggataacctggaggaaggtggggacgacgtcaaatcatcatgccccttatgaccagggctacacacgtgctacaatggcgtaaacagagggaagcagcctcgtgagagtgagcaaatcctaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggcgggaccgataactggggtgaagtcgtaacaaggtagccgtatcggaaggtgcggctggatcacctcctttctaaggaa

SEQ ID NO: 2812 - DNA, 1053 bp, Clostridium sp. USBA 49
  ref <308>: DATABASE ACCESSION NUMBER: NCBI ACCESSION: NZ_FUYD01000031.1
  ref <309>: DATABASE ENTRY DATE: 2019-04-01
  ref <313>: RELEVANT RESIDUES IN SEQ ID NO: (1)..(1053)
aggaagccacggctaactacgtgccagcagccgcggtaatacgtaggtggcaagcgttgtccggatttactgggcgtaaaggatgcgtaggcggatatttaagtcagatgtgaaaatcccgggctcaacttgggaactgcatttgaaactgggtatctagagtgcaggagaggaaagcggaattcctagtgtagcggtgaaatgcgtagagattaggaagaacaccagtggcgaaggcggctttctggactgtaactgacgctgaggcatgaaagcgtggggagcaaacaggattagataccctggtagtccacgccgtaaacgatgaatactaggtgtggggattgtcatgatctccgtgccgcagttaacacaataagtattccgcctggggagtacggtcgcaagattaaaactcaaaggaattgacgggggcccgcacaagcagcggagcatgtggtttaattcgaagcaacgcgaagaaccttacctagacttgacatctcctgaattactcgtaacggaggaagcccttcggggcaggaagacaggtggtgcatggttgtcgtcagctcgtgtcgtgagatgttgggttaagtcccgcaacgagcgcaacccttgtcgttagttgctaccattaagttgagcactctagcgagactgccgcggttaacgcggaggaaggtggggatgacgtcaaatcatcatgccccttatgtctagggctacacacgtgctacaatggtgagtacaaagagaaccgaaaccgcgaggtggaggaaaactcaaaaactcatcccagttcggattgcaggctgcaactcgcctgcatgaagatggagttgctagtaatcgcaaatcagaatgttgcggtgaatacgttcccgggccttgtacacaccgcccgtcacaccatgagagttgccaacacccgaagtccgtgaggtaaccttttggagccagcggccgaaggtgggggtagcgattggggtgaagtcgtaacaaggtagccgtaggagaacctgcggctggatcacctcctttctatggaga

SEQ ID NO: 2813 - DNA, 1526 bp, Clostridium sp. W14A
  ref <308>: DATABASE ACCESSION NUMBER: NCBI ACCESSION: NZ_MBSV01000087.1
  ref <309>: DATABASE ENTRY DATE: 2019-04-01
  ref <313>: RELEVANT RESIDUES IN SEQ ID NO: (1)..(1526)
ttttagagagtttgatcctggctcaggacgaacgctggcggcgtgcctaacacatgcaagtcgaacggaaacagattgaagcttgctttgaactgttttagtggcggacgggtgagtaacgcgtgaggaacctgcctttcagagggggataacgtctggaaacggacgctaataccgcatgacattttgttgccgcatggtgataaaatcaaaggagcaatccgctgagagatggactcgcgtccgattagccggttggcggggtaacggcccaccaaagcaacgatcggtagccgggctgagaggctgaacggccacattgggactgagacacggcccagactcctacgggaggcagcagtgggggatattgcacaatggaggaaactctgatgcagcaacgccgcgtgagggaagaaggttttcggattgtaaacctctgtcctcagggacgataatgacggtacctgaggaggaagctccggctaactacgtgccagcagccgcggtaatacgtagggagcaagcgttgtccggatttactgggtgtaaagggtgcgtaggcggcactgcaagtcaggtgtgaaaaccatgggcttaacttatggattgcacttgaaactgtggtgcttgagtgaagtagaggcaggcggaattcccggtgtagcggtgaaatgcgtagagatcgggaggaacaccagtggcgaaggcggcctgctgggctttaactgacgctgaggcacgaaagcatgggtagcaaacaggattagataccctggtagtccatgccgtaaacgatgattactaggtgtggggggtctgaccccttccgtgccggagttaacacaataagtaatccacctgggaagtacgaccgcaaggttgaaactcaaaggaattgacgggggcccgcacaagcagtggagtatgtggtttaattcgaagcaacgcgaagaaccttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgtgattagttgctacgctaagagcactctaatcagactgccgttgacaaaacggaggaaggtggggacgacgtcaaatcatcatgccccttatgacctgggctacacacgtactacaatggccgttaacaacgggaagcgaagccgcgaggcggagcaaaaccccaaaaacggtctcagttcggatcgcaggctgcaacccgcctgcgtgaagctggaattgctagtaatcgcggatcatcatgccgcggtgaatacgttcccgggccttgtacacaccgcccgtcacaccatgggagccggtaatacccgaagtcggtagcctaaccgcaaggaaggcgccgccgaaggtaggattggcgactggggtgaagtcgtaacaaggtagccgtatcggaaggtgcggctggatcacctcctttctatgga

SEQ ID NO: 2814 - DNA, 1514 bp, Clostridium tepidiprofundi
  ref <308>: DATABASE ACCESSION NUMBER: NCBI ACCESSION: NZ_LTBA01000115.1
  ref <309>: DATABASE ENTRY DATE: 2019-04-01
  ref <313>: RELEVANT RESIDUES IN SEQ ID NO: (1)..(1514)
ttttaaattgagagtttgatcctggctcaggacgaacgctggcggcgtgcctaacacatgcaagtcgagcgatgaagctaccttcgggtagtggaatagcggcggacgggtgagtaacacgtgggtaacctgcctcaaagagggggatagccctccgaaaggaggagtaataccgcataacatatatttctcgcatgagagatatatcaaagatttatcgctttgagatggacccgcgtcgcattagctagttggtgaggtaaaggctcaccaaggcgacgatgcgtagccgacctgagagggtgatcggccacattgggactgagacacggcccagactcctacgggaggcagcagtggggaatattgcgcaatgggggaaaccctgacgcagcaacgccgcgtgggtgaagaaggttttcggattgtaaagccctgttctataggacgataatgacggtactataggagaaagccacggctaactacgtgccagcagccgcggtaatacgtaggtggcaagcgttgtccggaattactgggcgtaaagagtgcgtaggcggataattaagtgagatgtgaaatacccgagctcaacttgggtgctgcatttcaaactggtaatctagagtgcaggagaggaaagcggaattcctagtgtagcggtgaaatgcgtagagattaggaagaacaccagtggcgaaggcggctttctggactgtaactgacgctgaggcacgaaagcgtggggagcgaacaggattagataccctggtagtccacgccgtaaacgatgggtactaggtgttgggggtcgaacctcagtgccgcagtaaacacaataagtaccccgcctggggagtacggtcgcaagattaaaactcaaaggaattgacgggggcccgcacaagcagcggagcatgtggtttaattcgaagcaacgcgaagaaccttacctagacttgacatcctaagaatcctttggaaacagaggagtgccttcgggaacttagagacaggtggtgcatggttgtcgtcagctcgtgtcgtgagatgttgggttaagtcccgcaacgagcgcaacccttattgttagttgctaccattaagttgagcactctagcgagactgcccgggtaaccgggaggaaggtggggatgacgtcaaatcatcatgccccttatgtctagggctacacacgtgctacaatggtcggtacaaagagaagcgaaatcgcgaggtggagcaaaactcaaaaaccgatctcagttcggattgcaggctgcaactcgcctgcatgaagctggagttgctagtaatcgcaaatcagaatgttgcggtgaatgcgttcccgggccttgtacacaccgcccgtcacaccatgagagccggcaacacccgaagtccgtgaggtaaccgaaaggagccagcggccgaaggtggggttggtgattggggtgaagtcgtaacaaggtagccgtaggagaacctgcggctggatcacctcctttcta

SEQ ID NO: 2815 - DNA, 1515 bp, Clostridium tyrobutyricum
  ref <308>: DATABASE ACCESSION NUMBER: NCBI ACCESSION: NZ_CP014170.1
  ref <309>: DATABASE ENTRY DATE: 2019-04-01
  ref <313>: RELEVANT RESIDUES IN SEQ ID NO: (1)..(1515)
ttttaaattgagagtttgatcctggctcaggacgaacgctggcggcgtgcctaacacatgcaagtcgagcgatgaaaccccttcgggggtggattagcggcggacgggtgagtaacacgtgggtaacctgcctcaaagtgggggatagccttccgaaaggaagattaataccgcataaagccaagtttcacatggaatttggatgaaaggagtaattcgctttgagatggacccgcggcgcattagttagttggtggggtaatggcctaccaagacagcgatgcgtagccgacctgagagggtgatcggccacattggaactgagatacggtccagactcctacgggaggcagcagtggggaatattgcacaatgggcgaaagcctgatgcagcaacgccgcgtgagtgatgaaggtcttcggattgtaaagctctgtcttttgggacgataatgacggtaccaaaggaggaagccacggctaactacgtgccagcagccgcggtaatacgtaggtggcgagcgttgtccggatttactgggcgtaaagggtgcgtaggcggatgtttaagtgagatgtgaaatacccgggcttaacttgggtgctgcatttcaaactggatatctagagtgcaggagaggagaatggaattcctagtgtagcggtgaaatgcgtagagattaggaagaacaccagtggcgaaggcgattctctggactgtaactgacgctgaggcacgaaagcgtgggtagcaaacaggattagataccctggtagtccacgccgtaaacgatgagtactaggtgtaggaggtatcgaccccttctgtgccgcagtaaacacattaagtactccgcctgggaagtacgatcgcaagattaaaactcaaaggaattgacgggggcccgcacaagcagcggagcatgtggtttaattcgaagcaacgcgaagaaccttacctggacttgacatcccctgaataacctagagataggcgaagcccttcggggcagggagacaggtggtgcatggttgtcgtcagctcgtgtcgtgagatgttaggttaagtcctgcaacgagcgcaacccttattgttagttgctaacattcagttgagcactctaacgagactgccgcggttaacgcggaggaaggtggggatgacgtcaaatcatcatgccccttatgtccagggcaacacacgtgctacaatgggcagaacaaagagaagcaataccgcgaggtggagccaaactcaaaaactgctctcagttcggattgcaggctgaaactcgcctgcatgaagctggagttgctagtaatcgcgaatcagcatgtcgcggtgaatacgttcccgggccttgtacacaccgcccgtcacaccatgagagctggcaacacccgaagtccgtagtctaacgtaagaggacgcggccgaaggtggggttagtgattggggtgaagtcgtaacaaggtagccgtaggagaacctgcggctggatcacctcctttcta

SEQ ID NO: 2816 - DNA, 1546 bp, Cobetia sp. ICG0124
  ref <308>: DATABASE ACCESSION NUMBER: NCBI ACCESSION: NZ_CP024893.1
  ref <309>: DATABASE ENTRY DATE: 2019-04-01
  ref <313>: RELEVANT RESIDUES IN SEQ ID NO: (1)..(1546)
caactgaagagtttgatcatggctcagattgaacgctggcggcaggcttaacacatgcaagtcgagcggaaacgattctagcttgctagaaggcgtcgagcggcggacgggtgagtaatgcatgggaatctgcccgatagtgggggacaacctggggaaactcaggctaataccgcatacgtcctacgggagaaagcaggggatcttcggaccttgcgctatcggatgagcccatgtcggattagcttgttggtgaggtaacggctcaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggccttcgggttgtaaagcactttcagcgaggaagaacgcttcgggattaatactcccgaggaaagacatcactcgcagaagaagcaccggctaactccgtgccagcagccgcggtaatacggagggtgcaagcgttaatcggaattactgggcgtaaagcgcgcgtaggtggctaagtcagccaggtgtgaaagccccgggctcaacctgggaacggcatctggaactgcttggctagagtgcaggagaggaaggtagaattcccggtgtagcggtgaaatgcgtagagatcgggaggaataccagtggcgaaggcggccttctggactgacactgacactgaggtgcgaaagcgtgggtagcaaacaggattagataccctggtagtccacgccgtaaacgatgtcaactagccgttgggtcccttgaggacttagtggcgcagctaacgcaataagttgaccgcctggggagtacggccgcaaggttaaaactcaaatgaattgacgggggcccgcacaagcggtggagcatgtggtttaattcgatgcaacgcgaagaaccttacctacccttgacatccagaggactttccagagatggattggtgccttcgggaactctgagacaggtgctgcatggctgtcgtcagctcgtgttgtgaaatgttgggttaagtcccgtaacgagcgcaacccctatccttatttgccagcgagtaatgtcgggaactctaaggagactgccggtgacaaaccggaggaaggtggggacgacgtcaagtcatcatggcccttacgggtagggctacacacgtgctacaatggcaagtacaaagggttgcaatacggcgacgtggagccaatcccataaagcttgcctcagtccggattggagtctgcaactcgactccatgaagtcggaatcgctagtaatcgtggatcagaatgccacggtgaatacgttcccgggccttgtacacaccgcccgtcacaccatgggagtggactgcaccagaagtggttagcctaaccttcgggagggcgatcaccacggtgtggttcatgactggggtgaagtcgtaacaaggtagccctaggggaacctggggctggatcacctccttatcgac

SEQ ID NO: 2817 - DNA, 1467 bp, Cognatishimia maritima
  ref <308>: DATABASE ACCESSION NUMBER: NCBI ACCESSION: NZ_FQWM01000007.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcttccttcgggaagagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaatggcctaccaagtctacgatctatagctggttttagaggatgatcagcaacactgggactgagacacggcccagactcctacgggaggcagcagtggggaatcttagacaatgggcgcaagcctgatctagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcgcgtaggcggattagtaagttaggggtgaaatcccgaggctcaacctcggaactgcctctaaaactgctagtcttgagttcgagagaggtaagtggaattccgagtgtagaggtgaaattcgtagatattcggaggaacaccagtggcgaaggcggcttactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 2818 - DNA, 1469 bp, Cognatiyoonia koreensis
  ref <308>: DATABASE ACCESSION NUMBER: NCBI ACCESSION: NZ_FOIZ01000002.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcacgcctaacacatgcaagtcgagcgctaccttcgggtggagcggcggacgggttagtaacgcgtgggaacatacccttttctgcggaatagcctttggaaacgaagagtaataccgcatacgcccttcgggggaaagatttatcggtgaaggattggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgaaagcctgatctagcgatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggattggaaagttagaggtgaaatcccagggctcaaccctggaactgcctttaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgggaccgctagagagatctagttttcacttcggtgactcagtgacaggtgctgcatggctgtcgtcagctcgtgtcgtgagatgttcggttaagtccggcaacgagcgcaacccacatctttagttgccagcagttcggctgggcactctaaagaaactgcccgtgataagcgggaggaaggtgtggatgacgtcaagtcctcatggcccttacgggttgggctacacacgtgctacaatggtgtctacagtgggttaatccccaaaagacatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 2819 - DNA, 1465 bp, Cognatiyoonia sediminum
  ref <308>: DATABASE ACCESSION NUMBER: NCBI ACCESSION: NZ_FQXB01000002.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacgtgcccttctctacggaatagcctttggaaacgaagagtaataccgtatacgcccttcgggggaaagatttatcggagaaggatcggcccgcgttagattagatagttggtggggtaacggcctaccaagtctacgatctatagctggtttgagaggatgatcagcaacactgggactgagacacggcccagactcctacgggaggcagcagtggggaatcttggacaatgggcgcaagcctgatccagccatgccgcgtgagtgacgaaggccctagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggattagaaagctagaggtgaaatcccggggctcaaccccggaactgcctttagaactactagtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaactccagagatggagtgtccacttcggtggcgcagtgacaggtgctgcatggctgtcgtcagctcgtgtcgtgagatgttcggttaagtccggcaacgagcgcaaccctcatccttagttgccagcagttcggctgggcactctaaggaaactgcccgtgataagcgggaggaaggtgaggatgacgtcaagtcttcatggcccttacgggttgggctacacacgtgctacaatggcaactacagtgggttaatccccaaaagttgtctcagttcggattggggtctgcaactcgaccccatgaagtcggaatcgctagtaatcgcggaacagcatgccgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 2820 - DNA, 1490 bp, Cohaesibacter gelatinilyticus
  ref <308>: DATABASE ACCESSION NUMBER: NCBI ACCESSION: NZ_OBEL01000012.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgaacgggctcttcggagctagtggcagacgggtgagtaacgcgtgggaacctacctataagtacggaacaacacagagaaatttgtgctaataccgtatgtgccctttggggtaaagatttatcgcttatagatgggcccgcgttagattagctagttggtgaggtaatggctcaccaaggcgacgatctatagctggtctgagaggatgatcagccacactgggactgagacacggcccagactcctacgggaggcagcagtgaggaatattggacaatgggggcaaccctgatccagccatgccgcgtgagtgatgacggccttagggttgtaaagctctttcgctagggaagataatgacggtacctagtaaagaagccccggctaacttcgtgccagcagccgcggtaatacgaagggggctagcgttgttcggaatcactgggcgtaaagcgcgcgtaggcggacttttaagtcaggggtgaaatcccggggctcaacctcggaactgcctttgatactggaagtcttgagttcgagagaggtgagtggaataccgagtgtagaggtgaaattcgtagatattcggtggaacaccagtggcgaaggcggctcactggctcgatactgacgctgaggtgcgaaagcgtggggagcaaacaggattagataccctggtagtccacgccgtaaacgatgaatgctagttgttggtgggtttactcatcagtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacataccggtcgcggatattggagacgatatccttcagtttggctggaccggatacaggtgctgcatggctgtcgtcagctcgtgtcgtgagatgttgggttaagtcccgcaacgagcgcaaccctcgcccttagttgccatcatttagttgggcactctagggggactgccggtgataagccggaggaaggtggggatgacgtcaagtcctcatggcccttacgggctgggctacacacgtgctacaatggtagtgacagagggcagcgactccgcgaggggaagctaatctccaaaaactatctcagttcggattgttctctgcaactcgagagcatgaagttggaatcgctagtaatcgcagatcagcatgctgcggtgaatacgttcccgggccttgtacacaccgcccgtcacaccatgggagttggttctacccgaaggcgatgcgctaaccgcaaggaggcagtcgaccacggtagggtcagcgactggggtgaagtcgtaacaaggtagccctaggggaacctggggctggatcacctcctttctaag

SEQ ID NO: 2821 - DNA, 1490 bp, Cohaesibacter haloalkalitolerans
  ref <308>: DATABASE ACCESSION NUMBER: NCBI ACCESSION: NZ_QNUM01000022.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgaacggacccttcggggttagtggcagacgggtgagtaacgcgtgggaacctacctataagtacggaacaacacagagaaatttgtgctaataccgtatgtggtcttcggattaaagatttatcgcttatagatgggcccgcgttagattaggtagttggtggggtaatggcctaccaagccgacgatctatagctggtctgagaggatgatcagccacattgggactgagacacggcccaaactcctacgggaggcagcagtgaggaatattggacaatgggggcaaccctgatccagccatgccgcgtgagtgatgacggccttagggttgtaaagctctttcgctagggaagataatgacggtacctagtaaagaagccccggctaacttcgtgccagcagccgcggtaatacgaagggggctagcgttgttcggaatcactgggcgtaaagcgcgcgtaggcggacttttaagtcaggggtgaaatcccgaggctcaacctcggaactgcctttgatactgggagtcttgagttcgagagaggtgagtggaataccgagtgtagaggtgaaattcgtagatattcggtggaacaccagtggcgaaggcggctcactggctcgatactgacgctgaggtgcgaaagcgtggggagcaaacaggattagataccctggtagtccacgccgtaaacgatgaatgctagttgtttgtgggtatactcataagtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacatcccgatcgcggttagtggagacactttccttcagttaggctggatcggtgacaggtgctgcatggctgtcgtcagctcgtgtcgtgagatgttgggttaagtcccgcaacgagcgcaaccctcgcccttagttgccagcattcagttgggcactctagggggactgccggtgataagccggaggaaggtggggatgacgtcaagtcctcatggcccttacgggctgggctacacacgtgctacaatggtagtgacagagggcagcgaggtcgcgaggccgagctaatctccaaaagctatctcagttcggattgttctctgcaactcgagagcatgaagttggaatcgctagtaatcgcagatcagcatgctgcggtgaatacgttcccgggccttgtacacaccgcccgtcacaccatgggagttggttctacccgaaggcgatgcgctaaccgcaaggaggcagtcgaccacggtagggtcagtgactggggtgaagtcgtaacaaggtagccctaggggaacctggggctggatcacctcctttctaag

SEQ ID NO: 2822 - DNA, 1491 bp, Cohaesibacter marisflavi
  ref <308>: DATABASE ACCESSION NUMBER: NCBI ACCESSION: NZ_FOVR01000034.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcaggcttaacacatgcaagtcgaacgggctcttcggagctagtggcagacgggtgagtaacgcgtgggaacctacctataagtacggaacaacacagagaaatttgtgctaataccgtatgtggtcttcggattaaagatttatcgcttatagatgggcccgcgttagattagctagttggtggggtaatggcctaccaaggcgacgatctatagctggtctgagaggatgatcagccacattgggactgagacacggcccaaactcctacgggaggcagcagtgaggaatattggacaatgggggcaaccctgatccagccatgccgcgtgagtgatgacggccttagggttgtaaagctctttcagtagtgaagataatgacggtaactacagaagaagccccggctaacttcgtgccagcagccgcggtaatacgaagggggctagcgttgttcggaatcactgggcgtaaagcgcgcgtaggcggacttttaagtcaggggtgaaatcccgaggctcaacctcggaactgcctttgatactggaagtcttgagttcgagagaggtgagtggaataccgagtgtagaggtgaaattcgtagatattcggtggaacaccagtggcgaaggcggctcactggctcgatactgacgctgaggtgcgaaagcgtggggagcaaacaggattagataccctggtagtccacgccgtaaacgatgaatgctagttgtttgtgggtatactcataagtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacataccgatcgcggtaacgagagattgttaccttcagctaggctggatcggatacaggtgctgcatggctgtcgtcagctcgtgtcgtgagatgttgggttaagtcccgcaacgagcgcaaccctcgcccttagttgccatcatttagttgggcactctagggggactgccggtgataagccggaggaaggtggggatgacgtcaagtcctcatggcccttacgggctgggctacacacgtgctacaatggtagtgacagagggcagcgaggtcgcgaggccgagctaatctccaaaagctatctcagttcggattgttctctgcaactcgagagcatgaagttggaatcgctagtaatcgcagatcagcatgctgcggtgaatacgttcccgggccttgtacacaccgcccgtcacaccatgggagttggttctacccgaaggcgatgcgctaaccgcaaggaggcagtcgaccacggtagggtcagtgactggggtgaagtcgtaacaaggtagccctaggggaacctggggctggatcacctcctttctaagg

SEQ ID NO: 2823 - DNA, 1493 bp, Cohaesibacter sp. ES.047
  ref <308>: DATABASE ACCESSION NUMBER: NCBI ACCESSION: NZ_LT907844.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcaggcttaacacatgcaagtcgaacggacccttcggggttagtggcagacgggtgagtaacgcgtgggaacctacctttaggtacggaacaacacagagaaatttgtgctaataccgtatgtgatcttcggatcaaagatttatcgcctaaggatgggcccgcgttagattagctagttggtggggtaatggcttaccaaggcgacgatctatagctggtctgagaggatgatcagccacactgggactgagacacggcccagactcctacgggaggcagcagtgaggaatattggacaatgggggcaaccctgatccagccatgccgcgtgagtgatgacggccttagggttgtaaagctctttcagtagtgaagataatgacggtaactacagaagaagccccggctaacttcgtgccagcagccgcggtaatacgaagggggctagcgttgttcggaatcactgggcgtaaagcgcgcgtaggcggacttttaagtcaggggtgaaatcccggggctcaacctcggaactgcctttgatactggaagtcttgagttcgagagaggtgagtggaataccgagtgtagaggtgaaattcgtagatattcggtggaacaccagtggcgaaggcggctcactggctcgatactgacgctgaggtgcgaaagcgtggggagcaaacaggattagataccctggtagtccacgccgtaaacgatgaatgctagttgtttgtgggtatactcataagtgacgcagttaacgcattaagcattccgcctggggagtacggtcgcaagattaaaactcaaaggaattgacgggggcccgcacaagcggtggagcatgtggtttaattcgaagcaacgcgcagaaccttaccagcccttgacataccgatcgcgattaccagagatggttttcttcagttaggctggatcggatacaggtgctgcatggctgtcgtcagctcgtgtcgtgagatgttgggttaagtcccgcaacgagcgcaaccctcgcccttagttgccatcatttagttgggcactctagggggactgccggtgataagccggaggaaggtggggatgacgtcaagtcctcatggcccttacgggctgggctacacacgtgctacaatggtagtgacagagggcagcgaggtcgcgaggccgagctaatctccaaaagctatctcagttcggattgttctctgcaactcgagagcatgaagttggaatcgctagtaatcgcagatcagcatgctgcggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccctaggggaacctggggctggatcacctcctttctaagg

SEQ ID NO: 2824 - DNA, 1492 bp, Cohaesibacter sp. H1304
  ref <308>: DATABASE ACCESSION NUMBER: NCBI ACCESSION: NZ_PKUQ01000054.1
  ref <309>: DATABASE ENTRY DATE: 2019-04-01
  ref <313>: RELEVANT RESIDUES IN SEQ ID NO: (1)..(1492)
aacttgagagtttgatcctggctcagaacgaacgctggcggcaggcttaacacatgcaagtcgaacggatccttcgggattagtggcagacgggtgagtaacgcgtgggaacctacctttaggtacggaacaactcagagaaatttgggctaataccgtatgtgatcttcggattaaagatttatcgcctaaggatgggcccgcgttagattagctagttggtgaggtaatggctcaccaaggcgacgatctatagctggtctgagaggatgatcagccacactgggactgagacacggcccagactcctacgggaggcagcagtgaggaatattggacaatgggggcaaccctgatccagccatgccgcgtgagtgatgacggccttagggttgtaaagctctttcagtagtgaagataatgacggtaactacagaagaagccccggctaacttcgtgccagcagccgcggtaatacgaagggggctagcgttgttcggaatcactgggcgtaaagcgcacgtaggcggacttttaagtcaggggtgaaatcccgaggctcaacctcggaactgcctttgatactggaagtcttgagttcgagagaggtaagtggaataccgagtgtagaggtgaaattcgtagatattcggtggaacaccagtggcgaaggcggcttactggctcgatactgacgctgaggtgcgaaagcgtggggagcaaacaggattagataccctggtagtccacgccgtaaacgatgaatgctagttgtttgtgggtatactcataagtgacgcagctaacgcattaagcattccgcctggggagtacggtcgcaagattaaaactcaaaggaattgacgggggcccgcacaagcggtggagcatgtggtttaattcgaagcaacgcgcagaaccttaccagcccttgacataccgatcgcggatagtggagacattatccttcagttaggctggatcggatacaggtgctgcatggctgtcgtcagctcgtgtcgtgagatgttgggttaagtcccgcaacgagcgcaaccctcgcccttagttgccatcatttagttgggcactctagggggactgccggtgataagccggaggaaggtggggatgacgtcaagtcctcatggcccttacgggctgggctacacacgtgctacaatggcagtgacagagggcagcgacaccgcgaggtgaagctaatctccaaaagctgtctcagttcggattgttctctgcaactcgagagcatgaagttggaatcgctagtaatcgtggatcagcatgccacggtgaatacgttcccgggccttgtacacaccgcccgtcacaccatgggagttggttctacccgaaggcgatgcgctaacccgcaagggaggcagtcgaccacggtagggtcagcgactggggtgaagtcgtaacaaggtagccctaggggaacctggggctggatcacctcctttctaag

SEQ ID NO: 2825 - DNA, 1561 bp, Cohnella kolymensis
  ref <308>: DATABASE ACCESSION NUMBER: NCBI ACCESSION: NZ_JXAL01000015.1
  ref <309>: DATABASE ENTRY DATE: 2019-04-01
  ref <313>: RELEVANT RESIDUES IN SEQ ID NO: (1)..(1561)
ttatggagagtttgatcctggctcaggacgaacgctggcggcgtgcctaatacatgcaagtcgagcggagttgatgagaagcttgcttctctgatacttagcggcggacgggtgagtaacacgtaggcaacctgcccacaagatcgggataacattcggaaacgaatgctaagaccggataaacagtcctctcgcatgggagggttgggaaagacggagcaatctgtcacttgcggatgggcctgcggcgcattagctagttggtgaggtaacggcccaccaaggcgacgatgcgtagccgacctgagagggtgaacggccacactgggactgagacacggcccagactcctacgggaggcagcagtagggaatcttccacaatgggcgaaagcctgatggagcaacgccgcgtgagtgaggaaggctttcgggtcgtaaagctctgttgccagggaagaataaggtcatgttaactgcatgatcgatgacggtacctgagaagaaagccccggctaactacgtgccagcagccgcggtaatacgtagggggcaagcgttgtccggaattattgggcgtaaagcgcgcgcaggcggttctttaagtctggtgtctaagtgcggggctcaaccccgtgatgcactggaaactggggaacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggggtccacccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaatcctctagagatagaggcggccttcgggacagaggagacaggtggtgcatggttgtcgtcagctcgtgtcgtgagatgttgggttaagtcccgcaacgagcgcaacccttgagcttagttgccagcacgtaatggtgggcactctaagctgactgccggtgacaaaccggaggaaggcggggatgacgtcaaatcatcatgccccttatgacctgggctacacacgtactacaatggccggtacaacgggtcgcgaagccgcgaggcggagccaatcctaccaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaaggag

SEQ ID NO: 2826 - DNA, 477 bp, Cohnella laeviribosi
  ref <308>: DATABASE ACCESSION NUMBER: NCBI ACCESSION: NZ_KB899814.1
  ref <309>: DATABASE ENTRY DATE: 2019-04-01
  ref <313>: RELEVANT RESIDUES IN SEQ ID NO: (1)..(477)
ccttttatggagagtttgatcctggctcaggacgaacgctggcggcgtgcctaatacatgcaagtcgagcggaccttcgagggagcttgcttccgagaaggttagcggcggacgggtgagtaacacgtaggcaacctgccctttagaccgggataacattcggaaacggatgctaagaccggataagcagcctcatcgcatgagggggctgggaaagacggagcaatctgtcactaaaggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccacaatgggcgaaagcctgatggagcaacgccgcgtgagtgaggaaggccttcgggtcgtaaagctctgttgccagggaagaataaggtccagtt

SEQ ID NO: 2827 - DNA, 1555 bp, Cohnella panacarvi
  ref <308>: DATABASE ACCESSION NUMBER: NCBI ACCESSION: NZ_KI911563.1
  ref <309>: DATABASE ENTRY DATE: 2019-04-01
  ref <313>: RELEVANT RESIDUES IN SEQ ID NO: (1)..(1555)
cttttatggagagtttgatcctggctcaggacgaacgctggcggcgtgcctaatacatgcaagtcgagcggagttatcccttcggggatagcttagcggcggacgggtgagtaacacgtaggcaacctgcccacaagaccgggataacattcggaaacgaatgctaagaccggatacgcaagcccggggcatctcgggcttgggaaacacggcgcaagctgtggcttgtggatgggcctgcggcgcattagctagttggcggggtaacggcccaccaaggcgacgatgcgtagccgacctgagagggtgaacggccacactgggactgagacacggcccagactcctacgggaggcagcagtagggaatcttccacaatgggcgcaagcctgatggagcaacgccgcgtgagtgaggaaggctttcgggtcgtaaagctctgttgccagggaagaataagggctagttaactgctagtccgatgacggtacctgagaagaaagccccggctaactacgtgccagcagccgcggtaatacgtagggggcaagcgttgtccggaattattgggcgtaaagcgcgcgcaggcggtcttttaagtctggtgtataagtgcggggctcaaccccgtgaggcactggaaactgggagacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggggtccacccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggccttcccttcggggcagaggagacaggtggtgcatggttgtcgtcagctcgtgtcgtgagatgttgggttaagtcccgcaacgagcgcaacccttgaacttagttgccagcacttcgggtgggcactctaggttgactgccggtgacaaaccggaggaaggcggggatgacgtcaaatcatcatgccccttatgacctgggctacacacgtactacaatggccggtacaacgggtcgcgaagccgcgaggcggagctaatcctaccaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagccgccgaaggtggggtagatgattggggtgaagtcgtaacaaggtagccgtatcggaaggtgcggctggatcacctcctttctaaggag

SEQ ID NO: 2828 - DNA, 1563 bp, Cohnella sp. 6021052837
  ref <308>: DATABASE ACCESSION NUMBER: NCBI ACCESSION: NZ_LT821253.1
  ref <309>: DATABASE ENTRY DATE: 2019-04-01
  ref <313>: RELEVANT RESIDUES IN SEQ ID NO: (1)..(1563)
tccctttatggagagtttgatcctggctcaggacgaacgctggcggcgtgcctaatacatgcaagtcgagcggatctttttaggtagcttgctacttaagaaggttagcggcggacgggtgagtaacacgtaggcaacctgccctttagcctgggataacattcggaaacgaatgctaagaccggatacgcagcttggtcgcatgagcgagctgggaaagacggagcaatctgtcgctaagggatgggcctgcggcgcattagctagttggtggggtaacggctcaccaaggcgacgatgcgtagccgacctgagagggtgaacggccacactgggactgagacacggcccagactcctacgggaggcagcagtagggaatcttccacagtgggcgaaagcctgatggagcaacgccgcgtgagtgaggaaggccttcgggtcgtaaagctctgttgccagggaagaataagggctagttaactgctagctcgatgacggtacctgagaagaaagccccggctaactacgtgccagcagccgcggtaatacgtagggggcaagcgttgtccggaattattgggcgtaaagcgcgcgcaggcggttctttaagtctggtgtttaagtgcggggctcaaccccgtgacgcactggaaactgggggacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacaggattagataccctggtagtccacgccgtaaacgatgagtgctaggtgttgggggggtccacccctcggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtctagagataggcctttccttcgggacagaggagacaggtggtgcatggttgtcgtcagctcgtgtcgtgagatgttgggttaagtcccgcaacgagcgcaacccttgatcttagttgccagcactttgggtgggcactctaaggtgactgccggtgacaaaccggaggaaggcggggatgacgtcaaatcatcatgccccttatgacctgggctacacacgtactacaatggccggtacaacgggaagcgaaagggcgacctggagccaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagccggtggggtaaccgcaaggagccagccgtcgaaggtggggtagatgattggggtgaagtcgtaacaaggtagccgtatcggaaggtgcggctggatcacctcctttctaagga

SEQ ID NO: 2829 - DNA, 225 bp, Cohnella thermotolerans
  ref <308>: DATABASE ACCESSION NUMBER: NCBI ACCESSION: NZ_AUCP01000070.1
  ref <309>: DATABASE ENTRY DATE: 2019-04-01
  ref <313>: RELEVANT RESIDUES IN SEQ ID NO: (1)..(225)
cctttatggagagtttgatcctggctcaggacgaacgctggcggcgtgcctaatacatgcaagtcgagcggactttcaagggagcttgctcccgcgaaggttagcggcggacgggtgagtaacacgtaggcaacctgcccgcaagaccgggataacattcggaaacgaatgctaagaccggatacgcaagagggaggcatcttcctgttgggaaacacggagcaa

SEQ ID NO: 2830 - DNA, 1495 bp, Coleofasciculus chthonoplastes
  ref <308>: DATABASE ACCESSION NUMBER: NCBI ACCESSION: NZ_DS989868.1
  ref <309>: DATABASE ENTRY DATE: 2019-04-01
  ref <313>: RELEVANT RESIDUES IN SEQ ID NO: (1)..(1495)
aatatggagagtttgatcctggctcaggatgaacgctggcggtctgcttaacacatgcaagtcgaacgcaaccttcgggttgagtggcggacgggtgagtaacgcgtgagaatctgccttggggtcggggacaaccactggaaacggtggctaataccggataagccttcgggtaaaagatttattgccccaagaggagctcgcgtctgattagctagttggtgaggtaagagctcaccaaggcagcgatcagtagctggtctgagaggacgatcagccacactgggactgagacacggcccagactcctacgggaggcagcagtggggaattttccgcaatgggcgaaagcctgacggagcaagaccgcgtgagggaggaaggctcttgggttgtaaacctcttttctcagggaagaagctctgacggtacctgaggaatcagcctcggctaactccgtgccagcagccgcggtaatacggaggaggcaagcgttatccggaattattgggcgtaaagcgtccgcaggtggcgattcaagtctgctgtcaaagcacggggcttaactccgttaaggcagtggaaactgaatagctagagtgccgtaggggtagagggaattcccggtgtagcggtgaaatgcgtagagatcgggaagaacatcggtggcgaaagcgctctactggacggcaactgacactcagggacgaaagctaggggagcgaatgggattagataccccagtagtcctagctgtaaacgatggatactaggtgtagcttgtatcgacccgagctgtgccgaagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaaccccggtgaaagctgggggtgccttcgggagccggaacacaggtggtgcatggctgtcgtcagctcgtgtcgtgagatgttgggttaagtcccgcaacgagcgcaaccctcgtctttagttgccagcattaagttgggcactctagagagactgccggtgacaaaccggaggaaggtggggatgacgtcaagtcagcatgccccttacgctctgggcgacacacgtactacaatggtcgggacagagggcagctaacctgcgaaggcaagctaatcccagaaactcggcctcagttcagatcgcaggctgcaactcgcctgcgtgaaggaggaatcgctagtaatcgccggtcagaatacggcggtgaatccgttcccgggccttgtacacaccgcccgtcacaccatggaagctggccacgcccgaagtcgttaccctaaccctccggggagggggacgccgaaggcagggttggtgactggggtgaagtcgtaacaaggtagccgtaccggaaggtgtggctggatcacctcctttttaggga

SEQ ID NO: 2831 - DNA, 1573 bp, Colibacter massiliensis
  ref <308>: DATABASE ACCESSION NUMBER: NCBI ACCESSION: NZ_FMIY01000002.1
  ref <309>: DATABASE ENTRY DATE: 2019-04-01
  ref <313>: RELEVANT RESIDUES IN SEQ ID NO: (1)..(1573)
atggagagtttgatcctggctcaggacgaacgctggcggcgtgcttaacacatgcaagtcgaacgagagacggtgaaaagcttgcttttaatcgaatcgagtggcaaacgggtgagtaacgcgtaaacaacctgcccctgggatggggacaacagctggaaacggctgctaataccgaatgagctccacatgccgcatggcaggtggaggaaagggtggcctctggaacaagctaccgccgagggaggggtttgcgtctgattagctggttggtgaggtaagggctcaccaaggcgacgatcagtagccggtctgagaggatgaacggccacattggaactgagagacggtccagactcctacgggaggcagcagtggggaatcttccgcaatgggcgaaagcctgacggagcaacgccgcgtgagtgaagacggccttcgggttgtaaagctctgttacacgggacgaacgggttttgtgcgaacagcataagaccgtgacggtaccgtagaagaaagccacggctaactacgtgccagcagccgcggtaatacgtaggtggcaagcgttgtccggaatgattgggcgtaaagggcgcgcaggcggccggccaagtctgtctaaaaagtgcggggcttaaccccgtgaggggagagaaactggccggctgagagtgtcggagaggaaagcggaattcctagtgtagcggtgaaatgcgtagatattaggaggaacaccggtggcgaaagcggctttctggacgacaactgacgctgaggcgcgaaagccaggggagcaaacgggattagataccccggtagtcctggccgtaaacgatgggtactaggtgtgggaggtatcgaccccttccgtgccggagttaacgcaataagtaccccgcctggggagtacggccgcaaggttgaaactcaaaggaattgacgggggcccgcacaagcggtggagtatgtggtttaattcgacgcaacgcgaagaaccttaccaagccttgacattgagtgaagggcgtagagatatgccgttcttcttcggaagacacgaaaacaggtggtgcacggctgtcgtcagctcgtgtcgtgagatgttgggttaagtcccgcaacgagcgcaacccttatcttcagttaccagcacgtagaggtggggactcaggagagactgccgcagacaatgcggaggaaggcggggatgacgtcaagtcatcatgcccctaatggcttgggctacacacgtactacaatggctctaaatagagggaagcaagggagcgatccggagcaaaccccaaaaacagagtcccagttcggattgcaggctgcaactcgcctgcatgaaggaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttctaggga

SEQ ID NO: 2832 - DNA, 1540 bp, Collimonas fungivorans
  ref <308>: DATABASE ACCESSION NUMBER: NCBI ACCESSION: NZ_RAIL01000001.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgccttacacatgcaagtcgaacggtaacagggagcttgctccgctgacgagtggcgaacgggtgagtaatatatcggaacgtacctttgagtgggggataactagtcgaaagactagctaataccgcatacgatctacggatgaaagtgggggatcgcaagacctcatgctcatagagcggccgatatctgattagctagttggtgaggtaaaggctcaccaaggcatcgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtctgatctaatacattgggctaatgacggtacctgaagaataagcaccggctaactacgtgccagcagccgcggtaatacgtagggtgcaagcgttaatcggaattactgggcgtaaagcgtgcgcaggcggttatgtaagacaggtgtgaaatccccgggcttaacctgggaatggcatttgtgactgcatggctagagtgtgtcagaggggggtagaattccacgtgtagcagtgaaatgcgtagagatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacagaatcccgaagagatttgggagtgttcgaaagaaagctgtaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcctaaccgtaaggagggcgcttaccacggtaggattcgtgactggggtgaagtcgtaacaaggtagccgtatcggaaggtgcggctggatcacctcctttctag

SEQ ID NO: 2833 - DNA, 1516 bp, Collinsella aerofaciens
  ref <308>: DATABASE ACCESSION NUMBER: NCBI ACCESSION: NZ_UFXC01000001.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcgccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2834 - DNA, 1510 bp, Collinsella intestinalis
  ref <308>: DATABASE ACCESSION NUMBER: NCBI ACCESSION: NZ_QSLJ01000004.1
  ref <309>: DATABASE ENTRY DATE: 2019-04-01
  ref <313>: RELEVANT RESIDUES IN SEQ ID NO: (1)..(1510)
ttggacggagagttcgatcctggctcaggatgaacgctggcggcgcgcctaacacatgcaagtcgaacggcacccaccctcgggtggaagcgagtggcgaacggctgagtaacacgtggagaacccgccccctcctccgggatagcctcgggaaaccgtgggtaataccggatgaccccgcagggccgcatggccccgcgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgaccgtgaagccggggagacccggtggccgagaggagcggtcacaggtggtgcatggctgtcgtcagctcgtgtcgtgagatgtttggttaagtccagcaacgagcgcaacccccgccgcatgttgccagcaccccgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtacgggaacgtgcggctggatcacctcctttctag

SEQ ID NO: 2835 - DNA, 1516 bp, Collinsella provencensis
  ref <308>: DATABASE ACCESSION NUMBER: NCBI ACCESSION: NZ_LT904906.1
  ref <309>: DATABASE ENTRY DATE: 2019-04-01
  ref <313>: RELEVANT RESIDUES IN SEQ ID NO: (1)..(1516)
ttggacggagagttcgatcctggctcaggatgaacgctggcggcgcgcctaacacatgcaagtcgaacggcacccgccctcgggcggaagcgagtggcgaacggctgagtaacacgtggagaacccgccccctcctccgggatagcctcgggaaaccgagggtaataccggatgcgcccgcacgtccgcatggacgcgcggggaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggatggaggccttcgggtcgtaaaccgctttcagcagggatgagacaagacggtacctgcagaagaagccccggctaactacgtgccagcagccgcggtaatacgtagggggcgagcgttatccggattcattgggcgtaaagagcgcgtaggcggccgggagggccgggggtcaaatgcgggggctcaacccccgcccgcccccggaaccgcccggctcgggtccggcaggggagggtggaacacccggtgtagcggtggaatgcgcagatatcgggtggaacaccggtggcgaaggcggccctctgggccggcaccgacgctgaggcgcgaaagctgggggagcgaacaggattagataccctggtagtcccagccgtaaacgatggacgctaggtgtggggggaaccgtccccccgtgccgaagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgaccgtgagcccggggagacccgggggccggaaggagcggtcacaggtggtgcatggctgtcgtcagctcgtgtcgtgagatgtttggttaagtccagcaacgagcgcaacccccgccgcatgttgccagcaggtgaagctgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatcccacaaagccggccccagttcggatcgggggctgcaacccgcccccgtgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgcctaaggtgtggagggcgaggggggtgaagtcgtaacaaggtagccgtacgggaacgtgcggctggatcacctcctttctagggag

SEQ ID NO: 2836 - DNA, 1516 bp, Collinsella sp. AF02-46-1
  ref <308>: DATABASE ACCESSION NUMBER: NCBI ACCESSION: NZ_QSBV01000008.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2837 - DNA, 1517 bp, Collinsella sp. AF04-24
  ref <308>: DATABASE ACCESSION NUMBER: NCBI ACCESSION: NZ_QSBK01000020.1
  ref <309>: DATABASE ENTRY DATE: 2019-04-01
  ref <313>: RELEVANT RESIDUES IN SEQ ID NO: (1)..(1517)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtcaaggggggaggcgccgaaggtgtggagggtgaggggggtgaagtcgtaacaaggtagccgtaccggaaggtgcggctggatcacctcctttctagggag

SEQ ID NO: 2838 - DNA, 1567 bp, Collinsella sp. AF05-8-2
  ref <308>: DATABASE ACCESSION NUMBER: NCBI ACCESSION: NZ_QSBC01000061.1
  ref <309>: DATABASE ENTRY DATE: 2019-04-01
  ref <313>: RELEVANT RESIDUES IN SEQ ID NO: (1)..(1567)
atggagagtttgatcctggctcaggacgaacgctggcggcgtgcttaacacatgcaagtcgaacgggaggaaaagagaagcttgcttctttttgaatctagtggcaaacgggtgagtaacacgtaaacaacctgccttcaggatggggacaacagacggaaacgactgctaataccgaatgtgttccggagaccgcatgatttccggaagaaaggatggcctctatttataagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatggacgaaagtctgacggagcaacgccgcgtgagtgatgacggccttcgggttgtaaagctctgtgatcggggacgaatggctggtatgctaataccatatcagagtgacggtacccgaatagcaagccacggctaactacgtgccagcagccgcggtaatacgtaggtggcaagcgttgtccggaattattgggcgtaaagcgcgcgcaggcggcttcttaagtccatcttaaaagtgcggggcttaaccccgtgatgggatggaaactgggaggctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgactgcaatcccgagaaatcgggagttcccttcggggacaggaaaacaggtggtgcacggctgtcgtcagctcgtgtcgtgagatgttgggttaagtcccgcaacgagcgcaacccctatcttatgttgccagcacgtaatggtgggaactcatgagagaccgccgcggacaacgcggaggaaggcggggatgacgtcaagtcatcatgccccttatgacctgggctacacacgtactacaatgggtgtcaacaaagagaagcaatggggcgacccggagcaaacctcaaaaacacacccccagttcagattgcaggctgcaacccgcctgcatgaagcaggaatcgctagtaatcgcgggtcagcataccgcggtgaatacgttcccgggccttgtacacaccgcccgtcacactatgagagtcagaaacacccgaagccggtgaggtaaccgtaaggagccagccgtcgaaggcggagctgatgattggagtgaagtcgtaacaaggtagccgtatcggaaggtgcggctggatcacctcctttcta

SEQ ID NO: 2839 - DNA, 1489 bp, Collinsella sp. AF05-9
  ref <308>: DATABASE ACCESSION NUMBER: NCBI ACCESSION: NZ_QSBB01000073.1
  ref <309>: DATABASE ENTRY DATE: 2019-04-01
  ref <313>: RELEVANT RESIDUES IN SEQ ID NO: (1)..(1489)
ggatgaacgctggcggcgcgcctaacacatgcaagtcgaacggcaccccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2840 - DNA, 1509 bp, Collinsella sp. AF08-23
  ref <308>: DATABASE ACCESSION NUMBER: NCBI ACCESSION: NZ_QUHV01000009.1
  ref <309>: DATABASE ENTRY DATE: 2019-04-01
  ref <313>: RELEVANT RESIDUES IN SEQ ID NO: (1)..(1509)
ttggacggagagttcgatcctggctcaggatgaacgctggcggcgcgcctaacacatgcaagtcgaacggcaccccccttcggggggaagcgagtggcgaacggctgagtaacacgtggagaacccgccccctcctccgggatagcctcgggaaaccgtgggtaataccggatgaccccggcaggccgcatggccggccgggcaaagcccagacgggaggggatggctccgcggcccatcaggtagacggcggggtgacggcccaccgtgccgacgacgggtagccgggttgagagaccgaccggccagattgggactgagacacggcccagactcctacgggaggcagcagtggggaatcttgcgcaatggggggaaccctgacgcagcgacgccgcgtgcgggacgaaggccctcgggtcgtaaaccgctttcagcagggatgagacaagacggtacctgcagaagaagccccggctaactacgtgccagcagccgcggtaatacgtagggggcgagcgttatccggattcattgggcgtaaagcgcgcgtaggcggcccggcaggcagggggtcaaatggcggggctcaaccccgtcccgccccctgaaccgccgggctcgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgtttggttaagtccagcaacgagcgcaacccccgccgcatgttgccagcacctcgggtgggcacccatgcgggaccgccggagtcaatccggaggagggcggggacgacgtcaagtcatcatgccccttatgccctgggctgcacacgtgctacaatggccggtacagcgggatgcgatggcgcgagccggagcggatccctgaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtttggggggaggcgccgaaggtgtggagggtgaggggggtgaagtcgtaacaaggtagccgtacgggaacgtgcggctggatcacctcctttcta

SEQ ID NO: 2841 - DNA, 1516 bp, Collinsella sp. AF11-11
  ref <308>: DATABASE ACCESSION NUMBER: NCBI ACCESSION: NZ_QSAS01000002.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccacctccgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2842 - DNA, 1516 bp, Collinsella sp. AF15-51
  ref <308>: DATABASE ACCESSION NUMBER: NCBI ACCESSION: NZ_QRYG01000010.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2843 - DNA, 1446 bp, Collinsella sp. AF16-8
  ref <308>: DATABASE ACCESSION NUMBER: NCBI ACCESSION: NZ_QRXX01000025.1
  ref <309>: DATABASE ENTRY DATE: 2019-04-01
  ref <313>: RELEVANT RESIDUES IN SEQ ID NO: (1)..(1446)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggaggg

SEQ ID NO: 2844 - DNA, 1516 bp, Collinsella sp. AF18-33LB
  ref <308>: DATABASE ACCESSION NUMBER: NCBI ACCESSION: NZ_QRXB01000005.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcgccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2845 - DNA, 1516 bp, Collinsella sp. AF18-8
  ref <308>: DATABASE ACCESSION NUMBER: NCBI ACCESSION: NZ_QRWV01000006.1
  ref <309>: DATABASE ENTRY DATE: 2019-04-01
  ref <313>: RELEVANT RESIDUES IN SEQ ID NO: (1)..(1516)
tttggacggagagttcgatcctggctaaggaagaacgctggcggcgcgcctaacacatgcaagtcgaacggcacctgccctcgggcagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2846 - DNA, 1516 bp, Collinsella sp. AF18-8LB
  ref <308>: DATABASE ACCESSION NUMBER: NCBI ACCESSION: NZ_QRWU01000016.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2847 - DNA, 1447 bp, Collinsella sp. AF19-1LB
  ref <308>: DATABASE ACCESSION NUMBER: NCBI ACCESSION: NZ_QRWO01000068.1
  ref <309>: DATABASE ENTRY DATE: 2019-04-01
  ref <313>: RELEVANT RESIDUES IN SEQ ID NO: (1)..(1447)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtcaaggggggaggcgccgaaggtgtggaggg

SEQ ID NO: 2848 - DNA, 1516 bp, Collinsella sp. AF19-7AC; identical to SEQ ID NO: 2836
  ref <308>: DATABASE ACCESSION NUMBER: NCBI ACCESSION: NZ_QRWG01000051.1
  ref <309>: DATABASE ENTRY DATE: 2019-04-01
  ref <313>: RELEVANT RESIDUES IN SEQ ID NO: (1)..(1516)

SEQ ID NO: 2849 - DNA, 1516 bp, Collinsella sp. AF20-14LB
  ref <308>: DATABASE ACCESSION NUMBER: NCBI ACCESSION: NZ_QRWD01000006.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccacctccgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2850 - DNA, 1516 bp, Collinsella sp. AF23-2; identical to SEQ ID NO: 2841
  ref <308>: DATABASE ACCESSION NUMBER: NCBI ACCESSION: NZ_QRVG01000045.1
  ref <309>: DATABASE ENTRY DATE: 2019-04-01
  ref <313>: RELEVANT RESIDUES IN SEQ ID NO: (1)..(1516)

SEQ ID NO: 2851 - DNA, 1516 bp, Collinsella sp. AF23-3LB; identical to SEQ ID NO: 2841
  ref <308>: DATABASE ACCESSION NUMBER: NCBI ACCESSION: NZ_QRVF01000017.1
  ref <309>: DATABASE ENTRY DATE: 2019-04-01
  ref <313>: RELEVANT RESIDUES IN SEQ ID NO: (1)..(1516)

SEQ ID NO: 2852 - DNA, 1516 bp, Collinsella sp. AF23-4AC
  ref <308>: DATABASE ACCESSION NUMBER: NCBI ACCESSION: NZ_QRVE01000014.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacctatcttcggatagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggcgagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2853 - DNA, 1516 bp, Collinsella sp. AF23-6; identical to SEQ ID NO: 2852
  ref <308>: DATABASE ACCESSION NUMBER: NCBI ACCESSION: NZ_QRVD01000004.1
  ref <309>: DATABASE ENTRY DATE: 2019-04-01
  ref <313>: RELEVANT RESIDUES IN SEQ ID NO: (1)..(1516)

SEQ ID NO: 2854 - DNA, 1516 bp, Collinsella sp. AF25-2LB; identical to SEQ ID NO: 2836
  ref <308>: DATABASE ACCESSION NUMBER: NCBI ACCESSION: NZ_QRUF01000004.1
  ref <309>: DATABASE ENTRY DATE: 2019-04-01
  ref <313>: RELEVANT RESIDUES IN SEQ ID NO: (1)..(1516)

SEQ ID NO: 2855 - DNA, 1429 bp, Collinsella sp. AF28-5AC
  ref <308>: DATABASE ACCESSION NUMBER: NCBI ACCESSION: NZ_QRTA01000011.1
  ref <309>: DATABASE ENTRY DATE: 2019-04-01
  ref <313>: RELEVANT RESIDUES IN SEQ ID NO: (1)..(1429)
gaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2856 - DNA, 1515 bp, Collinsella sp. AF31-11
  ref <308>: DATABASE ACCESSION NUMBER: NCBI ACCESSION: NZ_QRQS01000027.1
  ref <309>: DATABASE ENTRY DATE: 2019-04-01
  ref <313>: RELEVANT RESIDUES IN SEQ ID NO: (1)..(1515)
tttggacggagagttcgatcctggctcaggatgaacgctggcggcgcgcttaacacatgcaagtcgaacggcacctgccctcgggcagaagcgagtggcgaacggctgagtaacacgtggagaacctgccccctcccccgggatagccgcccgaaagaacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2857 - DNA, 1516 bp, Collinsella sp. AF33-16; identical to SEQ ID NO: 2842
  ref <308>: DATABASE ACCESSION NUMBER: NCBI ACCESSION: NZ_QRQC01000017.1
  ref <309>: DATABASE ENTRY DATE: 2019-04-01
  ref <313>: RELEVANT RESIDUES IN SEQ ID NO: (1)..(1516)

SEQ ID NO: 2858 - DNA, 1516 bp, Collinsella sp. AF36-3AT
  ref <308>: DATABASE ACCESSION NUMBER: NCBI ACCESSION: NZ_QROZ01000008.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccaccttcgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2859 - DNA, 1429 bp, Collinsella sp. AF37-9; identical to SEQ ID NO: 2855
  ref <308>: DATABASE ACCESSION NUMBER: NCBI ACCESSION: NZ_QROQ01000036.1
  ref <309>: DATABASE ENTRY DATE: 2019-04-01
  ref <313>: RELEVANT RESIDUES IN SEQ ID NO: (1)..(1429)

SEQ ID NO: 2860 - DNA, 1517 bp, Collinsella sp. AF38-3AC
  ref <308>: DATABASE ACCESSION NUMBER: NCBI ACCESSION: NZ_QROM01000025.1
  ref <309>: DATABASE ENTRY DATE: 2019-04-01
  ref <313>: RELEVANT RESIDUES IN SEQ ID NO: (1)..(1517)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgccaaggggggaggcgccgaaggtgtggagggtgaggggggtgaagtcgtaacaaggtagccgtaccggaaggtgcggctggatcacctcctttctagggag

SEQ ID NO: 2861 - DNA, 1516 bp, Collinsella sp. AF39-11AT
  ref <308>: DATABASE ACCESSION NUMBER: NCBI ACCESSION: NZ_QROG01000043.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagacgagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcgaggggggaggcgccgaaggtgtggagggtgaggggggtgaagtcgtaacaaggtagccgtaccggaaggtgcggctggatcacctcctttctagggag

SEQ ID NO: 2862 - DNA, 1429 bp, Collinsella sp. AM09-41; identical to SEQ ID NO: 2855
  ref <308>: DATABASE ACCESSION NUMBER: NCBI ACCESSION: NZ_QRMJ01000024.1
  ref <309>: DATABASE ENTRY DATE: 2019-04-01
  ref <313>: RELEVANT RESIDUES IN SEQ ID NO: (1)..(1429)

SEQ ID NO: 2863 - DNA, 1517 bp, Collinsella sp. AM10-11
  ref <308>: DATABASE ACCESSION NUMBER: NCBI ACCESSION: NZ_QRMH01000005.1
  ref <309>: DATABASE ENTRY DATE: 2019-04-01
  ref <313>: RELEVANT RESIDUES IN SEQ ID NO: (1)..(1517)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtctaggggggaggcgccgaaggtgtggagggtgaggggggtgaagtcgtaacaaggtagccgtaccggaaggtgcggctggatcacctcctttctagggag

SEQ ID NO: 2864 - DNA, 1517 bp, Collinsella sp. AM10-26; identical to SEQ ID NO: 2863
  ref <308>: DATABASE ACCESSION NUMBER: NCBI ACCESSION: NZ_QRMC01000003.1
  ref <309>: DATABASE ENTRY DATE: 2019-04-01
  ref <313>: RELEVANT RESIDUES IN SEQ ID NO: (1)..(1517)

SEQ ID NO: 2865 - DNA, 1430 bp, Collinsella sp. AM10-27
  ref <308>: DATABASE ACCESSION NUMBER: NCBI ACCESSION: NZ_QRMB01000017.1
  ref <309>: DATABASE ENTRY DATE: 2019-04-01
  ref <313>: RELEVANT RESIDUES IN SEQ ID NO: (1)..(1430)
gaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggtgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtctaggggggaggcgccgaaggtgtggagggtgaggggggtgaagtcgtaacaaggtagccgtaccggaaggtgcggctggatcacctcctttct

SEQ ID NO: 2866 - DNA, 1517 bp, Collinsella sp. AM10-32; identical to SEQ ID NO: 2863
  ref <308>: DATABASE ACCESSION NUMBER: NCBI ACCESSION: NZ_QRMA01000003.1
  ref <309>: DATABASE ENTRY DATE: 2019-04-01
  ref <313>: RELEVANT RESIDUES IN SEQ ID NO: (1)..(1517)

SEQ ID NO: 2867 - DNA, 1518 bp, Collinsella sp. AM10-48
  ref <308>: DATABASE ACCESSION NUMBER: NCBI ACCESSION: NZ_QRLZ01000008.1
  ref <309>: DATABASE ENTRY DATE: 2019-04-01
  ref <313>: RELEVANT RESIDUES IN SEQ ID NO: (1)..(1518)
tttggacggagagttcgatcctggctcaggatgaacgctggcggcacgcctaacacatgcaagtcgaacggcacccgccctcgggcagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcggggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtctaggggggaggcgccgaaggtgtggagggtgaggggggtgaagtcgtaacaaggtagccgtaccggaaggtgcggctggatcacctcctttctagggag

SEQ ID NO: 2868 - DNA, 1516 bp, Collinsella sp. AM12-1; identical to SEQ ID NO: 2861
  ref <308>: DATABASE ACCESSION NUMBER: NCBI ACCESSION: NZ_QRLS01000003.1
  ref <309>: DATABASE ENTRY DATE: 2019-04-01
  ref <313>: RELEVANT RESIDUES IN SEQ ID NO: (1)..(1516)

SEQ ID NO: 2869 - DNA, 1329 bp, Collinsella sp. AM13-34
  ref <308>: DATABASE ACCESSION NUMBER: NCBI ACCESSION: NZ_QRLE01000060.1
  ref <309>: DATABASE ENTRY DATE: 2019-04-01
  ref <313>: RELEVANT RESIDUES IN SEQ ID NO: (1)..(1329)
gaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccg

SEQ ID NO: 2870 - DNA, 1518 bp, Collinsella sp. AM15-2
  ref <308>: DATABASE ACCESSION NUMBER: NCBI ACCESSION: NZ_QRKO01000001.1
  ref <309>: DATABASE ENTRY DATE: 2019-04-01
  ref <313>: RELEVANT RESIDUES IN SEQ ID NO: (1)..(1518)
atttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtcaaggggggaggcgccgaaggtgtggagggtgaggggggtgaagtcgtaacaaggtagccgtaccggaaggtgcggctggatcacctcctttctagggag

SEQ ID NO: 2871 - DNA, 1516 bp, Collinsella sp. AM16-21; identical to SEQ ID NO: 2836
  ref <308>: DATABASE ACCESSION NUMBER: NCBI ACCESSION: NZ_QRKJ01000029.1
  ref <309>: DATABASE ENTRY DATE: 2019-04-01
  ref <313>: RELEVANT RESIDUES IN SEQ ID NO: (1)..(1516)

SEQ ID NO: 2872 - DNA, 1516 bp, Collinsella sp. AM17-1
  ref <308>: DATABASE ACCESSION NUMBER: NCBI ACCESSION: NZ_QRJZ01000009.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacctatcttcggatagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcgaggggggaggcgccgaaggtgtggagggtgaggggggtgaagtcgtaacaaggtagccgtaccggaaggtgcggctggatcacctcctttctagggag

SEQ ID NO: 2873 - DNA, 1517 bp, Collinsella sp. AM18-10
  ref <308>: DATABASE ACCESSION NUMBER: NCBI ACCESSION: NZ_QRJO01000029.1
  ref <309>: DATABASE ENTRY DATE: 2019-04-01
  ref <313>: RELEVANT RESIDUES IN SEQ ID NO: (1)..(1517)
tttggacggagagttcgatcctggctcaggatgaacgctggcggcgcgcctaacacatgcaagtcgaacggcacccacctccgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtcaaggggggaggcgccgaaggtgtggagggtgaggggggtgaagtcgtaacaaggtagccgtaccggaaggtgcggctggatcacctcctttctagggag

SEQ ID NO: 2874 - DNA, 1429 bp, Collinsella sp. AM20-15AC
  ref <308>: DATABASE ACCESSION NUMBER: NCBI ACCESSION: NZ_QRJA01000006.1
  ref <309>: DATABASE ENTRY DATE: 2019-04-01
  ref <313>: RELEVANT RESIDUES IN SEQ ID NO: (1)..(1429)
gaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2875 - DNA, 1516 bp, Collinsella sp. AM23-17
  ref <308>: DATABASE ACCESSION NUMBER: NCBI ACCESSION: NZ_QRHU01000003.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcgaggggggaggcgccgaaggtgtggagggtgaggggggtgaagtcgtaacaaggtagccgtaccggaaggtgcggctggatcacctcctttctagggag

SEQ ID NO: 2876 - DNA, 1429 bp, Collinsella sp. AM24-1; identical to SEQ ID NO: 2855
  ref <308>: DATABASE ACCESSION NUMBER: NCBI ACCESSION: NZ_QRHM01000056.1
  ref <309>: DATABASE ENTRY DATE: 2019-04-01
  ref <313>: RELEVANT RESIDUES IN SEQ ID NO: (1)..(1429)

SEQ ID NO: 2877 - DNA, 1516 bp, Collinsella sp. AM28-11LB
  ref <308>: DATABASE ACCESSION NUMBER: NCBI ACCESSION: NZ_QSKJ01000001.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctcttcggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2878 - DNA, 1517 bp, Collinsella sp. AM29-10AC; identical to SEQ ID NO: 2837
  ref <308>: DATABASE ACCESSION NUMBER: NCBI ACCESSION: NZ_QSKB01000006.1
  ref <309>: DATABASE ENTRY DATE: 2019-04-01
  ref <313>: RELEVANT RESIDUES IN SEQ ID NO: (1)..(1517)

SEQ ID NO: 2879 - DNA, 1517 bp, Collinsella sp. AM31-2AC; identical to SEQ ID NO: 2873
  ref <308>: DATABASE ACCESSION NUMBER: NCBI ACCESSION: NZ_QSJB01000002.1
  ref <309>: DATABASE ENTRY DATE: 2019-04-01
  ref <313>: RELEVANT RESIDUES IN SEQ ID NO: (1)..(1517)

SEQ ID NO: 2880 - DNA, 1516 bp, Collinsella sp. AM33-4BH
  ref <308>: DATABASE ACCESSION NUMBER: NCBI ACCESSION: NZ_QSIN01000006.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccacctccgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagacgagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagagggggggggcgccgaaggggtgggggggggggggggggaagtcgtaacaaggtagccgtaccggaaggtgcggctggatcacctcctttctagggag

SEQ ID NO: 2881 - DNA, 1516 bp, Collinsella sp. AM34-10
  ref <308>: DATABASE ACCESSION NUMBER: NCBI ACCESSION: NZ_QSIL01000014.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacctgccttcgggcagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2882 - DNA, 1516 bp, Collinsella sp. AM36-4AA; identical to SEQ ID NO: 2875
  ref <308>: DATABASE ACCESSION NUMBER: NCBI ACCESSION: NZ_QSHS01000045.1
  ref <309>: DATABASE ENTRY DATE: 2019-04-01
  ref <313>: RELEVANT RESIDUES IN SEQ ID NO: (1)..(1516)

SEQ ID NO: 2883 - DNA, 1415 bp, Collinsella sp. AM38-1BH
  ref <308>: DATABASE ACCESSION NUMBER: NCBI ACCESSION: NZ_QSHC01000018.1
  ref <309>: DATABASE ENTRY DATE: 2019-04-01
  ref <313>: RELEVANT RESIDUES IN SEQ ID NO: (1)..(1415)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaacc

SEQ ID NO: 2884 - DNA, 1516 bp, Collinsella sp. AM40-7AC
  ref <308>: DATABASE ACCESSION NUMBER: NCBI ACCESSION: NZ_QSGK01000004.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccacctccgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2885 - DNA, 1516 bp, Collinsella sp. AM41-2BH
  ref <308>: DATABASE ACCESSION NUMBER: NCBI ACCESSION: NZ_QSGH01000016.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacctatcttcggatagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2886 - DNA, 1516 bp, Collinsella sp. AM42-18AC
  ref <308>: DATABASE ACCESSION NUMBER: NCBI ACCESSION: NZ_QSFY01000017.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccacctccgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggcgaggggggtgaagtcgtaacaaggtagccgtaccggaaggtgcggctggatcacctcctttctagggag

SEQ ID NO: 2887 - DNA, 1516 bp, Collinsella sp. AM43-1; identical to SEQ ID NO: 2836
  ref <308>: DATABASE ACCESSION NUMBER: NCBI ACCESSION: NZ_QSFR01000033.1
  ref <309>: DATABASE ENTRY DATE: 2019-04-01
  ref <313>: RELEVANT RESIDUES IN SEQ ID NO: (1)..(1516)

SEQ ID NO: 2888 - DNA, 1516 bp, Collinsella sp. AM44-11; identical to SEQ ID NO: 2842
  ref <308>: DATABASE ACCESSION NUMBER: NCBI ACCESSION: NZ_QSFE01000006.1
  ref <309>: DATABASE ENTRY DATE: 2019-04-01
  ref <313>: RELEVANT RESIDUES IN SEQ ID NO: (1)..(1516)

SEQ ID NO: 2889 - DNA, 1517 bp, Collinsella sp. OM04-5
  ref <308>: DATABASE ACCESSION NUMBER: NCBI ACCESSION: NZ_QSUU01000001.1
  ref <309>: DATABASE ENTRY DATE: 2019-04-01
  ref <313>: RELEVANT RESIDUES IN SEQ ID NO: (1)..(1517)
atttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2890 - DNA, 1516 bp, Collinsella sp. OM06-18AC
  ref <308>: DATABASE ACCESSION NUMBER: NCBI ACCESSION: NZ_QSTX01000001.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacctgccctcgggcagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgcaaggggggaggcgccgaaggtgtggagggtgaggggggtgaagtcgtaacaaggtagccgtaccggaaggtgcggctggatcacctcctttctagggag

SEQ ID NO: 2891 - DNA, 1517 bp, Collinsella sp. OM07-12
  ref <308>: DATABASE ACCESSION NUMBER: NCBI ACCESSION: NZ_QSTQ01000043.1
  ref <309>: DATABASE ENTRY DATE: 2019-04-01
  ref <313>: RELEVANT RESIDUES IN SEQ ID NO: (1)..(1517)
tttggacggagagttcgatcctggctcaggatgaacgctggcggcgcgcctaacacatgcaagtcgaacggcacctgccctcgggcagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtctaggggggaggcgccgaaggtgtggagggtgaggggggtgaagtcgtaacaaggtagccgtaccggaaggtgcggctggatcacctcctttctagggag

SEQ ID NO: 2892 - DNA, 1516 bp, Collinsella sp. OM08-14AT
  ref <308>: DATABASE ACCESSION NUMBER: NCBI ACCESSION: NZ_QSTE01000004.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagacgagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2893 - DNA, 1517 bp, Collinsella sp. TF05-9AC
  ref <308>: DATABASE ACCESSION NUMBER: NCBI ACCESSION: NZ_QSSH01000015.1
  ref <309>: DATABASE ENTRY DATE: 2019-04-01
  ref <313>: RELEVANT RESIDUES IN SEQ ID NO: (1)..(1517)
tttggacggagagttcgatcctggctcaggatgaacgctggcggcgcgcctaacacatgcaagtcgaacggcacctatcttcggatagaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtcaaggggggaggcgccgaaggtgtggagggtgaggggggtgaagtcgtaacaaggtagccgtaccggaaggtgcggctggatcacctcctttctagggag

SEQ ID NO: 2894 - DNA, 1516 bp, Collinsella sp. TF06-6AC; identical to SEQ ID NO: 2836
  ref <308>: DATABASE ACCESSION NUMBER: NCBI ACCESSION: NZ_QSRW01000005.1
  ref <309>: DATABASE ENTRY DATE: 2019-04-01
  ref <313>: RELEVANT RESIDUES IN SEQ ID NO: (1)..(1516)

SEQ ID NO: 2895 - DNA, 1516 bp, Collinsella sp. TF07-1; identical to SEQ ID NO: 2858
  ref <308>: DATABASE ACCESSION NUMBER: NCBI ACCESSION: NZ_QSRV01000011.1
  ref <309>: DATABASE ENTRY DATE: 2019-04-01
  ref <313>: RELEVANT RESIDUES IN SEQ ID NO: (1)..(1516)

SEQ ID NO: 2896 - DNA, 1517 bp, Collinsella sp. TF08-11AT; identical to SEQ ID NO: 2837
  ref <308>: DATABASE ACCESSION NUMBER: NCBI ACCESSION: NZ_QSRL01000029.1
  ref <309>: DATABASE ENTRY DATE: 2019-04-01
  ref <313>: RELEVANT RESIDUES IN SEQ ID NO: (1)..(1517)

SEQ ID NO: 2897 - DNA, 1517 bp, Collinsella sp. TF09-1AT
  ref <308>: DATABASE ACCESSION NUMBER: NCBI ACCESSION: NZ_QSRC01000003.1
  ref <309>: DATABASE ENTRY DATE: 2019-04-01
  ref <313>: RELEVANT RESIDUES IN SEQ ID NO: (1)..(1517)
tttggacggagagttcgatcctggctcaggatgaacgctggcggcgcgcctaacacatgcaagtcgaacggcacccacctccgggtggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtgggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtcaaggggggaggcgccgaaggtgtggagggtgaggggggtgaagtcgtaacaaggtagccgtaccggaaggtgcggctggatcacctcctttctagggag

SEQ ID NO: 2898 - DNA, 1516 bp, Collinsella sp. TF10-11AT; identical to SEQ ID NO: 2861
  ref <308>: DATABASE ACCESSION NUMBER: NCBI ACCESSION: NZ_QSQW01000007.1
  ref <309>: DATABASE ENTRY DATE: 2019-04-01
  ref <313>: RELEVANT RESIDUES IN SEQ ID NO: (1)..(1516)

SEQ ID NO: 2899 - DNA, 1516 bp, Collinsella sp. TF11-5AC; identical to SEQ ID NO: 2836
  ref <308>: DATABASE ACCESSION NUMBER: NCBI ACCESSION: NZ_QSQO01000005.1
  ref <309>: DATABASE ENTRY DATE: 2019-04-01
  ref <313>: RELEVANT RESIDUES IN SEQ ID NO: (1)..(1516)

SEQ ID NO: 2900 - DNA, 1516 bp, Collinsella sp. TF12-2AT
  ref <308>: DATABASE ACCESSION NUMBER: NCBI ACCESSION: NZ_QSQK01000001.1
  ref <309>: DATABASE ENTRY DATE: 2019-04-01
  ref <313>: RELEVANT RESIDUES IN SEQ ID NO: (1)..(1516)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctgggtgtggggggacgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgagaggggggaggcgccgaaggtgtggagggtgaggggggtgaagtcgtaacaaggtagccgtaccggaaggtgcggctggatcacctcctttctagggag

SEQ ID NO: 2901 - DNA, 811 bp, Collinsella sp. TM04-29
  ref <308>: DATABASE ACCESSION NUMBER: NCBI ACCESSION: NZ_QSPW01000014.1
  ref <309>: DATABASE ENTRY DATE: 2019-04-01
  ref <313>: RELEVANT RESIDUES IN SEQ ID NO: (1)..(811)
tttggacggagagttcgatcctggctcaggatgaacgctggcggcgcgcctaacacatgcaagtcgaacggcacccctctccggagggaagcgagtggcgaacggctgagtaacacgtggagaacctgccccctcccccgggatagccgcccgaaaggacgggtaataccggataccccggggtgccgcatggcaccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagtcaagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggg

SEQ ID NO: 2902 - DNA, 811 bp, Collinsella sp. TM04-9; identical to SEQ ID NO: 2901
  ref <308>: DATABASE ACCESSION NUMBER: NCBI ACCESSION: NZ_QSPT01000002.1
  ref <309>: DATABASE ENTRY DATE: 2019-04-01
  ref <313>: RELEVANT RESIDUES IN SEQ ID NO: (1)..(811)

SEQ ID NO: 2903 - DNA, 1516 bp, Collinsella sp. TM05-37; identical to SEQ ID NO: 2858
  ref <308>: DATABASE ACCESSION NUMBER: NCBI ACCESSION: NZ_QSPN01000001.1
  ref <309>: DATABASE ENTRY DATE: 2019-04-01
  ref <313>: RELEVANT RESIDUES IN SEQ ID NO: (1)..(1516)

SEQ ID NO: 2904 - DNA, 1321 bp, Collinsella sp. TM05-38
  ref <308>: DATABASE ACCESSION NUMBER: NCBI ACCESSION: NZ_QSPM01000022.1
  ref <309>: DATABASE ENTRY DATE: 2019-04-01
  ref <313>: RELEVANT RESIDUES IN SEQ ID NO: (1)..(1321)
ccccggctaaagccccgacgggaggggatggctccgcggcccatcaggtagacggcggggtgacggcccaccgtgccgacaacgggtagccgggttgagagaccgaccggccagattgggactgagacacggcccagactcctacgggaggcagcagtggggaatcttgcgcaatggggggaaccctgacgcagcgacgccgcgtgcgggacggaggccttcgggtcgtaaaccgctttcagcagggaagagaagagactgtacctgcagaagaagccccggctaactacgtgccagcagccgcggtaatacgtagggggcgagcgttatccggattcattgggcgtaaagcgcgcgtaggcggcccggcaggccgggggtcgaagcggggggctcaaccccccgaagcccccggaacctccgcggcttgggtccggtaggggagggtggaacacccggtgtagcggtggaatgcgcagatatcgggtggaacaccggtggcgaaggcggccctctgggccgagaccgacgctgaggcgcgaaagctgggggagcgaacaggattagataccctggtagtcccagccgtaaacgatggacgctaggtgtggggggcgatccccccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatatgggtgaagcgggggagaccccgtggccgagaggagcccatacaggtggtgcatggctgtcgtcagctcgtgtcgtgagatgttgggttaagtcccgcaacgagcgcaacccccgccgcgtgttgccatcgggtgatgccgggaacccacgcgggaccgccgccgtcaaggcggaggagggcggggacgacgtcaagtcatcatgccccttatgccctgggctgcacacgtgctacaatggccggtacagagggatgccaccccgcgagggggagcggatcccggaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagtcgccggcccaaccgtctaggggggaggcgccgaaggtgtggagggtgaggggggtgaagtcgtaacaaggtagccgtaccggaaggtgcggctggatcacctcctttctagggag

SEQ ID NO: 2905 - DNA, 1516 bp, Collinsella sp. TM06-3; identical to SEQ ID NO: 2861
  ref <308>: DATABASE ACCESSION NUMBER: NCBI ACCESSION: NZ_QSPG01000013.1
  ref <309>: DATABASE ENTRY DATE: 2019-04-01
  ref <313>: RELEVANT RESIDUES IN SEQ ID NO: (1)..(1516)

SEQ ID NO: 2906 - DNA, 1516 bp, Collinsella sp. TM09-10AT; identical to SEQ ID NO: 2841
  ref <308>: DATABASE ACCESSION NUMBER: NCBI ACCESSION: NZ_QSOP01000002.1
  ref <309>: DATABASE ENTRY DATE: 2019-04-01
  ref <313>: RELEVANT RESIDUES IN SEQ ID NO: (1)..(1516)

SEQ ID NO: 2907 - DNA, 1517 bp, Collinsella sp. TM10-22; identical to SEQ ID NO: 2891
  ref <308>: DATABASE ACCESSION NUMBER: NCBI ACCESSION: NZ_QSOC01000008.1
  ref <309>: DATABASE ENTRY DATE: 2019-04-01
  ref <313>: RELEVANT RESIDUES IN SEQ ID NO: (1)..(1517)

SEQ ID NO: 2908 - DNA, 1518 bp, Collinsella tanakaei
  ref <308>: DATABASE ACCESSION NUMBER: NCBI ACCESSION: NZ_QSRJ01000025.1
  ref <309>: DATABASE ENTRY DATE: 2019-04-01
  ref <313>: RELEVANT RESIDUES IN SEQ ID NO: (1)..(1518)
tttggacggagagttcgatcctggctcaggatgaacgctggcggcgcgcctaacacatgcaagtcgaacggcacccctcctcggagggaagcgagtggcgaacggctgagtaacacgtggagaacctgccccctcctcggggatagccgcgggaaaccgcgggtaacacccgacgaccccggagccgcgcatgcggcgccgggcaaatctccggagggaggggatggctccgcggcccatcaggtagacggcggggtaacggcccaccgtgccgacaacgggtagccgggttgagagaccgaccggccagattgggactgagacacggcccagactcctacgggaggcagcagtggggaatcttgcgcaatgggggcaaccctgacgcagcgacgccgcgtgcgggacgaaggccttcgggtcgtaaaccgctttcagcagggacgagacaagacggtacctgcagaagaagccccggctaactacgtgccagcagccgcggtaatacgtagggggcgagcgttatccggattcattgggcgtaaagcgcgcgtaggcggccgcgtaggcggggggtcaaatcccggggctcaaccccggtccgccccccgaaccccgcggctcgggtccggtaggggagggtggaattcccggtgtagcggtggaatgcgcagatatcgggaggaacaccggtggcgaaggcggccctctgggccgagaccgacgctgaggcgcgaaagctgggggagcgaacaggattagataccctggtagtcccagccgtaaacgatggacgctaggtgtggggggacgatccctccgtgccgcagccaacgcattaagcgtcccgcctggggagtacggccgcaaggctaaaactcaaaggaattgacgggggcccgcacaagcagcggagcatgtggcttaattcgaagcaacgcgaagaaccttaccagggcttgacatgtgcgtgaagccggggagacccggtggccgagaggagcgcacacaggtggtgcatggctgtcgtcagctcgtgtcgtgagatgttgggttaagtcccgcaacgagcgcaacccccgccgcatgttgccagcaggtcaggctgggcacccatgcgggaccgccggcgtcaagccggaggagggcggggacgacgtcaagtcatcatgccccttatgccctgggctgcacacgtgctacaatggccggtacagcgggatgcgatggcgcgagccggagcggatccctcaaagccggccccagttcggattgggggctgcaacccgcccccatgaagtcggagttgctagtaatcgcggatcagcatgccgcggtgaatgcgttcccgggccttgtacacaccgcccgtcacaccacccgagtcgtctgcacccgaagccgccggcccaaccttccgaggggggaggcgtcgaaggtgtggagggtgaggggggtgaagtcgtaacaaggtagccgtacgggaacgtgcggctggatcacctcctttctagggag

SEQ ID NO: 2909 - DNA, 1544 bp, Comamonadaceae bacterium NML161473
  ref <308>: DATABASE ACCESSION NUMBER: NCBI ACCESSION: NZ_RDQL01000029.1
  ref <309>: DATABASE ENTRY DATE: 2019-04-01
  ref <313>: RELEVANT RESIDUES IN SEQ ID NO: (1)..(1544)
agatcgaactaaagagtttgatcctggctcagattgaacgctggcggcatgctttacacatgcaagtcgaacggcagcgcgggcttcggcctggcggcgagtggcgaacgggtgagtaatacatcggaacatgcccacttgtgggggatagctcggcgaaagccggattaataccgcatgagatctacggatgaaagcaggggaccttcgggccttgcgcgagtggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccctcgggttgtaaactgcttttgtacagaacgaaaagagctgggttaataccctggttttatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccctgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggccgcaaggctaaaactcaaaggaattgacggggacccgcacaagcggtggatgatgtggtttaattcgatgcaacgcgaaaaaccttacccacctttgacatgtacggaacttgccagagatggcttggtgcccgaaagggagccgtaacacaggtgctgcatggctgtcgtcagctcgtgtcgtgagatgttgggttaagtcccgcaacgagcgcaacccttgtcattagttgccatcatttggttgggcactctaatgagactgccggtgataaaccggaggaaggtggggatgacgtcaagtcctcatggcccttataggtggggctacacacgtcatacaatggccggtacaaagggttgctaagccgcgaggtggagctaatcccacaaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtaccggaaggtgcggctggatcacctcctttctg

SEQ ID NO: 2910 - DNA, 1544 bp, Comamonadaceae bacterium NML180581
  ref <308>: DATABASE ACCESSION NUMBER: NCBI ACCESSION: NZ_RDQK01000040.1
  ref <309>: DATABASE ENTRY DATE: 2019-04-01
  ref <313>: RELEVANT RESIDUES IN SEQ ID NO: (1)..(1544)
agatcgaactaaagagtttgatcctggctcagattgaacgctggcggcatgctttacacatgcaagtcgaacggcagcgcgggcttcggcctggcggcgagtggcgaacgggtgagtaatacatcggaacatgcccacttgtgggggatagctcggcgaaagccggattaataccgcatgagatctacggatgaaagcaggggaccttttggccttgcgcgagtggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccctcgggttgtaaactgcttttgtacagaacgaaaagagctgggttaataccctggttttatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaatttattttttcagtaacgaagctaacgcgtgaagttgaccgcctggggagtacggccgcaaggctaaaactcaaaggaattgacggggacccgcacaagcggtggatgatgtggtttaattcgatgcaacgcgaaaaaccttacccacctttgacatgtacggaacttgccagagatggcttggtgcccgaaagggagccgtaacacaggtgctgcatggctgtcgtcagctcgtgtcgtgagatgttgggttaagtcccgcaacgagcgcaacccttgtcattagttgccatcatttggttgggcactctaatgagactgccggtgataaaccggaggaaggtggggatgacgtcaagtcctcatggcccttataggtggggctacacacgtcatacaatggccggtacaaagggttgctaagccgcgaggtggagctaatcccacaaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgcaaggagggcgcttaccacggcagggctcgtgactggggtgaagtcgtaacaaggtagccgtaccggaaggtgcggctggatcacctcctttctg

SEQ ID NO: 2911 - DNA, 1541 bp, Comamonadaceae bacterium NML180582
  ref <308>: DATABASE ACCESSION NUMBER: NCBI ACCESSION: NZ_RDQJ01000044.1
  ref <309>: DATABASE ENTRY DATE: 2019-04-01
  ref <313>: RELEVANT RESIDUES IN SEQ ID NO: (1)..(1541)
gaactaaagagtttgatcctggctcagattgaacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggatcatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcatttggttgggcactctaatgagactgccggtgataaaccggaggaaggtggggatgacgtcaagtcctcatggcccttataggtggggctacacacgtcatacaatggccggtacaaagggcagccaacccgcgagggggagccaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgcaaggagggcgcttaccacggcagggctcgtgactggggtgaagtcgtaacaaggtagccgtaccggaaggtgcggctggatcacctcctttctg

SEQ ID NO: 2912 - DNA, 1544 bp, Comamonadaceae bacterium NML970147; identical to SEQ ID NO: 2909
  ref <308>: DATABASE ACCESSION NUMBER: NCBI ACCESSION: NZ_RDQM01000026.1
  ref <309>: DATABASE ENTRY DATE: 2019-04-01
  ref <313>: RELEVANT RESIDUES IN SEQ ID NO: (1)..(1544)

SEQ ID NO: 2913 - DNA, 1541 bp, Comamonadaceae bacterium OH2310 COT-174
  ref <308>: DATABASE ACCESSION NUMBER: NCBI ACCESSION: NZ_RQYQ01000027.1
  ref <309>: DATABASE ENTRY DATE: 2019-04-01
  ref <313>: RELEVANT RESIDUES IN SEQ ID NO: (1)..(1541)
gaactaaagagtttgatcctggctcagattgaacgctggcggcatgctttacacatgcaagtcgaacggtaacatgggtgcttgcacctgatgacgagtggcgaacgggtgagtaatacatcggaacatgcccaattgtgggggatagctcggcgaaagccggattaataccgcataagatctacggatgaaagcaggggaccttcgggccttgcgcgattggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccttcgggttgtaaactgcttttgtacagaacgaaaagtctctggttaatacctggggatcatgacggtactgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggtcgcaagactaaaactcaaaggaattgacggggacccgcacaagcggtggatgatgtggtttaattcgatgcaacgcgaaaaaccttacccacctttgacatgtacggaacttgccagagatggcttggtgctcgaaagagagccgtaacacaggtgctgcatggctgtcgtcagctcgtgtcgtgagatgttgggttaagtcccgcaacgagcgcaacccttgtcattagttgccatcattaagttgggcactctaatgagactgccggtgataaaccggaggaaggtggggatgacgtcaagtcctcatggcccttataggtggggctacacacgtcatacaatggccggtacaaagggcagccaacccgcgagggggagcaaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtaccggaaggtgcggctggatcacctcctttctg

SEQ ID NO: 2914 - DNA, 1537 bp, Comamonadaceae bacterium OH2545 COT-014
  ref <308>: DATABASE ACCESSION NUMBER: NCBI ACCESSION: NZ_RQYR01000034.1
  ref <309>: DATABASE ENTRY DATE: 2019-04-01
  ref <313>: RELEVANT RESIDUES IN SEQ ID NO: (1)..(1537)
agatcgaactgtagagtttgatcctggctcagattgaacgctggcggaatgctttacacatgcaagtcgagcggcagcgcggggcaacctggcggcgagcggcgaacgggtgagtaatacatcggaacgtgcccagacgtgggggatagcccggcgaaagccggattaataccgcatgtgatctgaggatgaaagcgggggaccttcgggcctcgcgcgtttggagcggccgatggcagattaggtagttggtggggtaaaggcttaccaagcctgcgatctgtagctggtctgagaggatgatcagccacactgggactgagacacggcccagactcctacgggaggcagcagtggggaattttggacaatgggcgaaagcctgatccagccattccgcgtgcaggacgaaggccctcgggttgtaaactgcttttgtacagaacgaaaagtctctggttaacacctggggatcatgacggtactgtaagaataagcaccggctaactacgtgccagcagccgcggtaatacgtagggtgcgagcgttaatcggaattactgggcgtaaagcgtgcgcaggcggtgatgtaagacagttgtgaaatccccgggctcaacctgggaactgcatctgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaatttgctttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaacttgccagagatggcttggtgcccgaaagggagccgtaacacaggtgctgcatggctgtcgtcagctcgtgtcgtgagatgttgggttaagtcccgcaacgagcgcaacccttgccattagttgctacgaaagggcactctaatgggactgccggtgataaaccggaggaaggtggggatgacgtcaagtcctcatggcccttataggtggggctacacacgtcatacaatggctggtacagagggttgccaacccgcgagggggagccaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggtctcgccagaagtgggtagcctaaccgcaaggagggcgcttaccacggcggggttcgtgactggggtgaagtcgtaacaaggtagccgtatcggaaggtgcggctggatcacctcctttctg

SEQ ID NO: 2915 - DNA, 1544 bp, Comamonadaceae bacterium OH3737 COT-264
  ref <308>: DATABASE ACCESSION NUMBER: NCBI ACCESSION: NZ_RQYX01000039.1
  ref <309>: DATABASE ENTRY DATE: 2019-04-01
  ref <313>: RELEVANT RESIDUES IN SEQ ID NO: (1)..(1544)
agatcgaactaaagagtttgatcctggctcagattgaacgctggcggcatgctttacacatgcaagtcgaacggcagcgcgggcttcggcctggcggcgagtggcgaacgggtgagtaatacatcggaacatgcccacttgtgggggatagctcggcgaaagccggattaataccgcatgagatctacggatgaaagcaggggaccttcgggccttgcgcgagtggagtggccgatggcagattaggtagttggtggggtaaaggcctaccaagcctgcgatctgtagctggtctgagaggacgaccagccacactgggactgagacacggcccagactcctacgggaggcagcagtggggaattttggacaatgggcgcaagcctgatccagcaatgccgcgtgcaggacgaaggccctcgggttgtaaactgcttttgtacagaacgaaaagagctgggttaataccctggttttatgacggtactgtaagaataagcaccggctaactacgtgccagcagccgcggtaatacgtagggtgcaagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattcatttcttcagtaacgaagctaacgcgtgaagttgaccgcctggggagtacggccgcaaggctaaaactcaaaggaattgacggggacccgcacaagcggtggatgatgtggtttaattcgatgcaacgcgaaaaaccttacccacctttgacatgtacggaacttgccagagatggcttggtgcccgaaagggagccgtaacacaggtgctgcatggctgtcgtcagctcgtgtcgtgagatgttgggttaagtcccgcaacgagcgcaacccttgtcattagttgccatcatttggttgggcactctaatgagactgccggtgataaaccggaggaaggtggggatgacgtcaagtcctcatggcccttataggtggggctacacacgtcatacaatggccggtacaaagggttgctaagccgcgaggtggagctaatcccacaaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtaccggaaggtgcggctggatcacctcctttctg

SEQ ID NO: 2916 - DNA, 1537 bp, Comamonadaceae bacterium SYSU G00088
  ref <308>: DATABASE ACCESSION NUMBER: NCBI ACCESSION: NZ_QOAZ01000010.1
  ref <309>: DATABASE ENTRY DATE: 2019-04-01
  ref <313>: RELEVANT RESIDUES IN SEQ ID NO: (1)..(1537)
agatcgaactgaagagtttgatcctggctcagattgaacgctggcggcatgccttacacatgcaagtcgaacggtaacgcggggcaacctggcgacgagtggcgaacgggtgagtaatgcatcggaacgtacccagtagtgggggatagcccggcgaaagccggattaataccgcatacgacctacgggtgaaagcgggggaccgcaaggcctcgcgctattggagcggccgatgtcggattagctagttggtggggtaaaggcctaccaaggcgacgatccgtagctggtctgagaggacgaccagccacactgggactgagacacggcccagactcctacgggaggcagcagtggggaattttggacaatgggggcaaccctgatccagccatgccgcgtgcgggaagaaggccttcgggttgtaaaccgcttttgtcagggaagaaacgcgctgggctaatacctcggcgtaatgacggtacctgaagaataagcaccggctaactacgtgccagcagccgcggtaatacgtagggtgcgagcgttaatcggaattactgggcgtaaagcgtgcgcaggcggttgtgcaagacagatgtgaaatccccgggcttaacctgggaactgcatttgtgactgcacggctagagtacggcagagggggatggaattccgcgtgtagcagtgaaatgcgtagatatgcggaggaacaccgatggcgaaggcagtcccctgggcctgtactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgcccggaatcctgtagagatgtgggagtgctcgaaagagaaccgggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 2917 - DNA, 1537 bp, Comamonadaceae bacterium YIM 73032
  ref <308>: DATABASE ACCESSION NUMBER: NCBI ACCESSION: NZ_QNUI01000013.1
  ref <309>: DATABASE ENTRY DATE: 2019-04-01
  ref <313>: RELEVANT RESIDUES IN SEQ ID NO: (1)..(1537)
agatcgaactgaagagtttgatcctggctcagattgaacgctggcggcatgccttacacatgcaagtcgaacggtaacgcggggcaacctggcgacgagtggcgaacgggtgagtaatgcatcggaacgtacccagtagtgggggatagcccggcgaaagccggattaataccgcatacgacctacgggtgaaagcgggggaccgcaaggcctcgcgctattggagcggccgatgtcggattagctagttggtggggtaaaggcctaccaaggcgacgatccgtagctggtctgagaggacgaccagccacactgggactgagacacggcccagactcctacgggaggcagcagtggggaattttggacaatgggggcaaccctgatccagccatgccgcgtgcgggaagaaggccttcgggttgtaaaccgcttttgtcagggaagaaacgcgctgggctaatacctcggcgtaatgacggtacctgaagaataagcaccggctaactacgtgccagcagccgcggtaatacgtagggtgcgagcgttaatcggaattactgggcgtaaagcgtgcgcaggcggttgtgcaagacaggtgtgaaatccccgggcttaacctgggaactgcatttgtgactgcacggctagagtacggcagagggggatggaattccgcgtgtagcagtgaaatgcgtagatatgcggaggaacaccgatggcgaaggcagtcccctgggcctgtactgacgctcatgcacgaaagcgtggggagcaaacaggattagataccctggtagtccacgccctaaacgatgtcaactggttgttggacggcttgctgttcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacctacccttgacatgcccggaatcctgcagagatgtgggagtgctcgaaagagaaccgggacacaggtgctgcatggccgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaggtcctcatggcccttatgggtagggctacacacgtcatacaatggccggtacagagggctgccaacccgcgagggggagccaatcccagaaaaccggtcgtagtccggatcgcagtctgcaactcgactgcgtgaagtcggaatcgctagtaatcgcggatcagcttgccgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 2918 - DNA, 1537 bp, Comamonas sp. BIGb0124
  ref <308>: DATABASE ACCESSION NUMBER: NCBI ACCESSION: NZ_RJVF01000004.1
  ref <309>: DATABASE ENTRY DATE: 2019-04-01
  ref <313>: RELEVANT RESIDUES IN SEQ ID NO: (1)..(1537)
agatcgaactgtagagtttgatcctggctcagattgaacgctggcggcatgccttacacatgcaagtcgaacggtaacaggtcttcggatgctgacgagtggcgaacgggtgagtaaagcatcggaacgtgcccagtcgtgggggataactgctcgaaagagcagctaataccgcatacgacctaagggtgaaagcgggggaccttcgggcctcgcgcgattggagcggccgatgtcagattagatagttggtggggtaaaggcttaccaagtcgacgatctgtagctggtctgagaggacgaccagccacactgggactgagacacggcccagactcctacgggaggcagcagtggggaattttggacaatgggcgaaagcctgatccagcaatgccgcgtgcaggaagaaggccttcgggttgtaaactgcttttgtacggaacgaaaaggttctttttaataaagaggactgatgacggtaccgtaagaataagcaccggctaactacgtgccagcagccgcggtaatacgtagggtgcgagcgttaatcggaattactgggcgtaaagcgtgcgcaggcggtgatgtaagacagatgtgaaatccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtgaccagagatggacatgtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggtctcgccagaagtaggtagcctaaccgtaaggagggcgcttaccacggcggggttcgtgactggggtgaagtcgtaacaaggtagccgtatcggaaggtgcggctggatcacctcctttctg

SEQ ID NO: 2919 - DNA, 1537 bp, Comamonas sp. JNW
  ref <308>: DATABASE ACCESSION NUMBER: NCBI ACCESSION: NZ_QETI01000030.1
  ref <309>: DATABASE ENTRY DATE: 2019-04-01
  ref <313>: RELEVANT RESIDUES IN SEQ ID NO: (1)..(1537)
agatcgaactatagagtttgatcctggctcagattgaacgctggcggcatgctttacacatgcaagtcgaacggtaacaggtcttcggatgctgacgagtggcgaacgggtgagtaacacatcggaacgtgcctagtagtgggggataactactcgaaagagtagctaataccgcatgagatctaaggatgaaagcaggggaccttcgggccttgcgctactagagcggctgatggcagattaggtagttggtgggataaaagcttaccaagccgacgatctgtagctggtctgagaggacgaccagccacactgggactgagacacggcccagactcctacgggaggcagcagtggggaattttggacaatgggcgaaagcctgatccagcaatgccgcgtgtaggatgaaggccctcgggttgtaaactacttttgtacggaacgaaaagctctcttctaataaaggagagtgatgacggtaccgtaagaataagcaccggctaactacgtgccagcagccgcggtaatacgtagggtgcgagcgttaatcggaattactgggcgtaaagcgtgcgcaggcggttatgtaagacagaggtgaaatccccgggctcaacctgggaacggcctttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggaattaactttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaagtgaccagagatggacatgtgctcgaaagagaaccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtaggtagcctaaccgcaaggagggcgcttaccacggcggggttcgtgactggggtgaagtcgtaacaaggtagccgtatcggaaggtgcggctggatcacctcctttctg

SEQ ID NO: 2920 - DNA, 1536 bp, Comamonas sp. lk
  ref <308>: DATABASE ACCESSION NUMBER: NCBI ACCESSION: NZ_UOOB01000001.1
  ref <309>: DATABASE ENTRY DATE: 2019-04-01
  ref <313>: RELEVANT RESIDUES IN SEQ ID NO: (1)..(1536)
gaactatagagtttgatcctggctcagattgaacgctggcggcatgctttacacatgcaagtcgaacggtaacagcacttcggtggctgacgagtggcgaacgggtgagtaatacatcggaacgtgcctagtagtgggggataactactcgaaagagtagctaataccgcatgagatctacggatgaaagcaggggaccttcgggccttgtgctactagagcggctgatggcagattaggtagttggtggggtaaaggctcaccaagccaacgatctgtagctggtctgagaggacgaccagccacactggaactgagacacggtccagactcctacgggaggcagcagtggggaattttggacaatgggcgcaagcctgatccagcaatgccgcgtgcaggatgaaggccttcgggttgtaaactgcttttgtacagaacgaaaagtcttgggttaataccctgggaccatgacggtactgtaagaataagcaccggctaactacgtgccagcagccgcggtaatacgtagggtgcaagcgttaatcggaattactgggcgtaaagcgtgcgcaggcggttatgtaagacagaggtgaaatccccgggctcaacctgggaacggcctttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttaactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgccattagttgctacatttagttgagcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgccgtccgcaattcgactgcgacaagccggaatcgccagtaatcgtagaccaggacgacacggtgaatacgttcccgggtgttgtacactccgcccgtcacaccatgggagcgggtctcgccagaagtaggtagcctaaccgcaaggagggcgcttaccacggcggggttcgtgactggggtgaagtcgtaacaaggtagccgtatcggaaggtgcggctggatcacctcctttctg

SEQ ID NO: 2921 - DNA, 1541 bp, Comamonas terrigena
  ref <308>: DATABASE ACCESSION NUMBER: NCBI ACCESSION: NZ_UIGV01000001.1
  ref <309>: DATABASE ENTRY DATE: 2019-04-01
  ref <313>: RELEVANT RESIDUES IN SEQ ID NO: (1)..(1541)
agatcgaactgtagagtttgatcctggctcagattgaacgctggcggcatgctttacacatgcaagtcgaacggcagcacggacttcggtctggtggcgagtggcgaacgggtgagtaatacatcggaacgtgcccagttgtgggggataactactcgaaagagtagctaataccgcatgagaactgaggtttgaaagcaggggatcgcaagaccttgcgcaactggagcggccgatggcagattaggtagttggtgggataaaagcttaccaagccgacgatctgtagctggtctgagaggacgaccagccacactgggactgagacacggcccagactcctacgggaggcagcagtggggaattttgggacaatgggcgaaagcctgatccagcaatgccgcgtgcaggatgaaggcctttcgggttgtaaactgcttttgtacggaacgaaaagcttcgggttaatacccctggagtcatgacggtaccgtaagaataagcacggctaactacgtgccagcagcccgggtaatacgtagggtgcaagcgttaatcggaattactgggcgtaaagcgtgcgcaggcggtcttgtaagacagaggtgaaatccccgggctcaacctgggaactgcctttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttaactgactcagtaacgaagctaacgcgtgaagttgaccgcctggggagtacggccgcaaggttgaaactcaaaggaattgacggggacccgcacagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtaggtagcctaaccgtaaggagggcgcttaccacggcggggttcgtgactggggtgaagtcgtaacaaggtagccgtatcggaaggtgcggctggatcacctcctttctg

SEQ ID NO: 2922 - DNA, 1541 bp, Comamonas testosteroni
  ref <308>: DATABASE ACCESSION NUMBER: NCBI ACCESSION: NZ_UFXL01000002.1
  ref <309>: DATABASE ENTRY DATE: 2019-04-01
  ref <313>: RELEVANT RESIDUES IN SEQ ID NO: (1)..(1541)
agatcgaactatagagtttgatcctggctcagattgaacgctggcggcatgctttacacatgcaagtcgaacggtaacaggtcttcggatgctgacgagtggcgaacgggtgagtaatacatcggaacgtgcctagtagtgggggataactactcgaaagagtagctaataccgcatgagatctacggatgaaagcaggggaccttcgggccttgtgctactagagcggctgatggcagattaggtagttggtggggtaaaggcttaccaagcctgcgatctgtagctggtctgagaggacgaccagccacactgggactgagacacggcccagactcctacgggaggcagcagtggggaattttggacaatgggcgaaagcctgatccagcaatgccgcgtgcaggatgaaggccctcgggttgtaaactgcttttgtacggaacgaaaagcctggggctaatatccccgggtcatgacggtaccgtaagaataagcaccggctaactacgtgccagcagccgcggtaatacgtagggtgcaagcgttaatcggaattactgggcgtaaagcgtgcgcaggcggttttgtaagacagtggtgaaatccccgggctcaacctgggaactgccattgtgactgcaaggctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttaactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaacttaccagagatggtttggtgctcgaaagagaacctgcacacaggtgctgcatggctgtcgtcagctcgtgtcgtgagatgttgggttaagtcccgcaacgagcgcaacccttgccattagttgctacattcagttgagcactctaatgggactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggtctcgccagaagtaggtagcctaaccgcaaggagggcgcttaccacggcggggttcgtgactggggtgaagtcgtaacaaggtagccgtatcggaaggtgcggctggatcacctcctttctg

SEQ ID NO: 2923 - DNA, 1495 bp, Commensalibacter intestini
  ref <308>: DATABASE ACCESSION NUMBER: NCBI ACCESSION: NZ_JOPB01000023.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagtgaacgctggcggcatgcttaacacatgcaagtcgcacggatgcttcggcattagtggcggacgggtgagtaacgcgtagggatctatccacgagtgggggataactttgggaaactgaagctaataccgcatgatacctgagggtcaaaggagtgatccgcttgtggaggaacctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtatgaagaaggtcttcggattgtaaagtactttcgacagggacgatgatgacggtacctgtagaagaagccccggctaacttcgtgccagcagccgcggtaatacgaagggggctagcgttactcggaatgactgggcgtaaagggcgcgtaggcggcttatacagtcagatgtgaaattcctgggcttaacctgggacctgcatttgatacgtataggctagagtgtgaaagaggattgtggaattccaagtgtagaggtgaaattcgtagatatttggaggaacaccggtggcgaaggcggcaatctggttcacaactgacgctgaggcgcgaaagcgtggggagcaaacaggattagataccctggtagtccacgctgtaaacgatgtatgctagatgttaggtaacttagttacttagtgtcgaagttaacgcgataagcataccgcctggggagtacggccgcaaggttgaaactcaaaggaattgacgggggcccgcacaagcggtggagcatgtggtttaattcgaagcaacgcgcagaaccttaccaggtcttgacatgtagacgctgtatccagagatggatgcttccagcaatggacgtctaacacaggtgctgcatggctgtcgtcagctcgtgtcgtgagatgttgggttaagtcccgcaacgagcgcaacccttgcctttagttgccagcatgtttgggtgggcactctagggggactgccggtgataagccggaggaaggtagggatgacgtcaagtcctcatggcccttatgacctgggctacacacgtgctacaatggtggtgacagaaggaagcgaagtagtgatgctaagcagatctttaaaaaccatctcagttcagattgcactctgcaactcgagtgcatgaaggcggaatcgctagtaatcgcggatcagcatgccgcggtgaatacgttcccgggccttgtacacaccgcccgtcacaccatgggagttggtttgaccttaagccggtgagcgaaccgtaaggacgcagccgaccacggtcgggtcagcgactggggtgaagtcgtaacaaggtagccgtaggggaacctgcggctggatcacctcctttcaag

SEQ ID NO: 2924 - DNA, 1495 bp, Commensalibacter sp. AMU001
  ref <308>: DATABASE ACCESSION NUMBER: NCBI ACCESSION: NZ_CP033087.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacggacatttcggtgttagtggcggacgggtgagtaacgcgtagggatctgtccataagagggggataactttgggaaactggagctaataccgcatgatacctgagggttaaaggagtgatccgcttatggaggaacctgcgtttgattagctggttggtggggtaatggcctaccaaggcgatgatcgatagctggtttgagaggatgatcagccacactgggactgagacacggcccagactcctacgggaggcagcagtggggaatattggacaatgggggcaaccctgatccagcaatgccgcgtgtatgaagaaggtcttcggattgtaaagtactttcggtagggacgatgatgacggtacctacagaagaagccccggctaacttcgtgccagcagccgcggtaatacgaagggggctagcgttgctcggaatgactgggcgtaaagggcgcgcaggcggtctggacagtcagatgtgaaattcccgggcttaacctgggggctgcatttgatacgttcagactagagtgtgaaagagggttgtggaactccaagtgtagaggtgaaattcgtagatatttggaagaacaccggtggcgaaggcggcgacctggttcacaactgacgctgaggcgcgaaagcgtggggagcaaacaggattagataccctggtagtccacgctgtaaacgatgtatgctagatgttaggcaacctagttgtttagtgtcggagctaacgcgataagcataccgcctggggagtacggccgcaaggttgaaactcaaaggaattgacgggggcccgcacaagcggtggagcatgtggtttaattcgaagcaacgcgcagaaccttaccaggtcttgacatgtagacgctgtattcagagatgaatgcttccagcaatggacgtctaacacaggtgctgcatggctgtcgtcagctcgtgtcgtgagatgttgggttaagtcccgcaacgagcgcaacccttgcctttagttgccatcacgtttgggtgggcactctagagggactgccggtgataagccggaggaaggtagggatgacgtcaagtcctcatggcccttatgacctgggctacacacgtgctacaatggtggtgacagagggaagcgaggcagtgatgctgagcagatctttaaaagccatctcagttcagattgcactctgcaactcgagtgcatgaaggcggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 2925 - DNA, 1495 bp, Commensalibacter sp. ESL0284
  ref <308>: DATABASE ACCESSION NUMBER: NCBI ACCESSION: NZ_QGLT01000010.1
  ref <309>: DATABASE ENTRY DATE: 2019-04-01
  ref <313>: RELEVANT RESIDUES IN SEQ ID NO: (1)..(1495)
atgaacctgagagtttgatcctggctcagagcgaacgctggcggcatgcttaacacatgcaagtcgcacggacatttcggtgttagtggcggacgggtgagtaacgcgtagggatctgtccataagagggggataactttgggaaactggagctaataccgcatgatacctgagggttaaaggagtgatccgcttatggaggaacctgcgtttgattagctagttggtggggtaatggcctaccaaggcgatgatcgatagctggtttgagaggatgatcagccacactgggactgagacacggcccagactcctacgggaggcagcagtggggaatattggacaatgggggcaaccctgatccagcaatgccgcgtgtatgaagaaggtcttcggattgtaaagtactttcggtagggacgatgatgacggtacctacagaagaagccccggctaacttcgtgccagcagccgcggtaatacgaagggggctagcgttgctcggaatgactgggcgtaaagggcgcgcaggcggtttggacagtcagatgtgaaattcccgggcttaacctgggggctgcatttgatacgttcagactagagtgtgaaagagggttgtggaactccaagtgtagaggtgaaattcgtagatatttggaagaacaccggtggcgaaggcggcgacctggttcacaactgacgctgaggcgcgaaagcgtggggagcaaacaggattagataccctggtagtccacgctgtaaacgatgtatgctagatgttaggcaacctagttgtttagtgtcggagctaacgcgataagcataccgcctggggagtacggccgcaaggttgaaactcaaaggaattgacgggggcccgcacaagcggtggagcatgtggtttaattcgaagcaacgcgcagaaccttaccaggtcttgacatgtagacgctgtattcagagatgaatgcttccagcaatggacgtctaacacaggtgctgcatggctgtcgtcagctcgtgtcgtgagatgttgggttaagtcccgcaacgagcgcaacccttgcctttagttgccatcatgtttgggtgggcactctagagggactgccggtgataagccggaggaaggtagggatgacgtcaagtcctcatggcccttatgacctgggctacacacgtgctacaatggtggtgacagagggaagcgaggcagtgatgctgagcagatctttaaaagccatctcagttcagattgtactctgcaactcgagtacatgaaggcggaatcgctagtaatcgcggatcagcatgccgcggtgaatacgttcccgggccttgtacacaccgcccgtcacaccatgggagttggtttgaccttaagccggtgagcgaaccgcaaggacgcagccgaccacggtcgggtcagcgactggggtgaagtcgtaacaaggtagccgtaggggaacctgcggctggatcacctcctttcaag

SEQ ID NO: 2926 - DNA, 1498 bp, Commensalibacter sp. MX01
  ref <308>: DATABASE ACCESSION NUMBER: NCBI ACCESSION: NZ_ATSX01000009.1
  ref <309>: DATABASE ENTRY DATE: 2019-04-01
  ref <313>: RELEVANT RESIDUES IN SEQ ID NO: (1)..(1498)
atgaacctgagagtttgatcctggctcagagtgaacgctggcggcatgcttaacacatgcaagtcgcacggatacttcggtattagtggcggacgggtgagtaacgcgtagggatctatccacgagtgggggataactttgggaaactgaagctaataccgcatgatacctgagggtcaaaggagtgatccgcttgtggaggaacctgcgtttgattagctagttggtggggtaaaggcctaccaaggcgatgatcaatagctggtttgagaggatgatcagccacactgggactgagacacggcccagactcctacgggaggcagcagtggggaatattggacaatgggggcaaccctgatccagcaatgccgcgtgtatgaagaaggtcttcggattgtaaagtactttcgatagggacgatgatgacggtacctatagaagaagccccggctaacttcgtgccagcagccgcggtaatacgaagggggctagcgttactcggaatgactgggcgtaaagggcgcgtaggcggtttgaatagttagatgtgaaattcctgggcttaacctgggacctgcatttgatacgtttagactagagtgtgagagaggattgtggaattccaagtgtagaggtgaaattcgtagatatttggaggaacaccggtggcgaaggcggcaatctggctcacaactgacgctgaggcgcgaaagcgtggggagcaaacaggattagataccctggtagtccacgctgtaaacgatgtatgctagatgttaggtaacttagttacttagtgtcgaagttaacgcgataagcataccgcctggggagtacggccgcaaggttgaaactcaaaggaattgacgggggcccgcacaagcggtggagcatgtggtttaattcgaagcaacgcgcagaaccttaccaggtcttgacatgtagacgacgtatatagagatatatatttccagcaatggacgtctaacacaggtgctgcatggctgtcgtcagctcgtgtcgtgagatgttgggttaagtcccgcaacgagcgcaacccttgcctttagttgccagcatgtttgggtgggcactctagagggactgccggtgataagccggaggaaggtagggatgacgtcaagtcctcatggcccttatgacctgggctacacacgtgctacaatggtggtgacagaaggaagcgaagtagtgatgctaagcggatctttaaaagccatctcagttcagattgcactctgcaactcgagtgcatgaaggcggaatcgctagtaatcgcggatcagcatgccgcggtgaatacgttcccgggccttgtacacaccgcccgtcacaccatgggagttggtttgaccttaagccggtgagcgaacccgcaaggggcgcagccgaccacggtcgggtcagcgactggggtgaagtcgtaacaaggtagccgtaggggaacctgcggctggatcacctcctttcaagg

SEQ ID NO: 2927 - DNA, 1528 bp, Compostimonas suwonensis
  ref <308>: DATABASE ACCESSION NUMBER: NCBI ACCESSION: NZ_PGFB01000009.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacgatgaaggggagcttgcttcttggattagtggcgaacgggtgagtaacacgtgagtaacctgcccttgactctgggataactgcgggaaactgtagctaataccggatatgaccctccgctgcatggtgagggggtggaaagattttttggtcaaggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtaggggccattccacggtttctgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaaagtgcagaaatgtgctccccgtaaggtcggtatacaggtggtgcatggttgtcgtcagctcgtgtcgtgagatgttgggttaagtcccgcaacgagcgcaaccctcgttctatgttgccagcacgttatggtgggaactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccttgtgggaggagctgtcgaaggtgggatcggtgattaggactaagtcgtaacaaggtagccgtaccggaaggtgcggctggatcacctcctttctaagga

SEQ ID NO: 2928 - DNA, 1335 bp, Conchiformibius steedae
  ref <308>: DATABASE ACCESSION NUMBER: NCBI ACCESSION: NZ_RQYC01000059.1
  ref <309>: DATABASE ENTRY DATE: 2019-04-01
  ref <313>: RELEVANT RESIDUES IN SEQ ID NO: (1)..(1335)
tgacctcgcgttatccgagcggccaatgtctgattagctagttggtggggtaaaagcctaccaaggcaacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcggggaagaaaaggttgtggctaatacccatgactgatgacggtacccgaagaataagcaccggctaactacgtgccagcagccgcggtaatacgtagggtgcgagcgttaatcggaattactgggcgtaaagcgggcgcagacggttatttaagcaggatgtgaaatccctgggctcaacctgggaacggcgttctgaactggatagctagagtgtgtcagaggggggtagaattccacgtgtagcagtgaaatgcgtagagatgtggaggaataccgatggcgaaggcagccccctgggataacactgacgttcatgcccgaaagcgtgggtagcaaacaggattagataccctggtagtccacgccctaaacgatgtcaattagctgttggggtactagataccttagtagcgtagctaacgcgtgaaattgaccgcctggggagtacggtcgcaagattaaaactcaaaggaattgacggggacccgcacaagcggtggatgatgtggattaattcgatgcaacgcgaagaaccttacctggtcttgacatgtacggaaggtcttagagataggactgtgccttcgggaaccgtaacacaggtgctgcatggctgtcgtcagctcgtgtcgtgagatgttgggttaagtcccgcaacgagcgcaacccttgtcatcagttgccatcattaagttgggcactctgatgagactgccggtgacaaaccggaggaaggtggggatgacgtcaagtcctcatggcccttatgaccagggcttcacacgtcatacaatggtcggtacaaagggtagccaagccgcgaggcggagccaatcccagaaaaccgatcgtagtccggattgcactctgcaactcgagtgcatgaagtcggaatcgctagtaatcgcaggtcagcatactgcggtgaatacgttcccgggtcttgtacacaccgcccgtcacaccatgggagtgggggataccagaattgggtagggtaaccgtaaggagcccgcttaacacggtatgcttcatgactggggtgaagtcgtaacaaggtagccgtaggggaacctgcggctggatcacctcctttctag

SEQ ID NO: 2929 - DNA, 1470 bp, Confluentimicrobium sp. EMB200-NS6
  ref <308>: DATABASE ACCESSION NUMBER: NCBI ACCESSION: NZ_CP010869.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcttaacacatgcaagtcgagcgaagacttcggtcttagcggcggacgggtgagtaacgcgtgggaacgtgcccttttctgcggaatagccttgggaaactgagagtaataccgcatacgcccttcgggggaaagatttatcggagaaggatcggcccgcgttagattaggtagttggtggggtaatggcctaccaagccgacgatctatagctggtttgagaggatgatcagccacactgggactgagacacggcccagactcctacgggaggcagcagtgaggaatcttggacaatgggggcaaccctgatccagccatgccgcgtgaacgatgaaggccttagggttgtaaagttctttcaacggtgaagataatgacggtagccgtagaagaaaccccggctaactccgtgccagcagccgcggtaatacggagggggttagcgttgttcggaattactgggcgtaaagcgcacgtaggcggattggaaagttagaggtgaaatcccagggctcaaccctggaactgcctttaaaactcccagtctagagttcgagagaggtgagtggaattgcgagtgtagaggtgaaattcgtagatattcgcaggaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacctgtcgcggatccagagatggatctttcagttcggctggacaggatacaggtgctgcatggctgtcgtcagctcgtgtcgtgagatgttcggttaagtccggcaacgagcgcaacccacgtctttagttgccagcagttcggctgggcactctaaagaaactgccgatgataagtcggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggccgtgcgccaacctttcgagggggcagcggaccacggtgagctcagcgactggggtgaagtcgtaacaaggtagccgtaggggaacctgcggctggatcacctcctttctaa

SEQ ID NO: 2930 - DNA, 1484 bp, Consotaella salsifontis
  ref <308>: DATABASE ACCESSION NUMBER: NCBI ACCESSION: NZ_FUXL01000010.1
  ref <309>: DATABASE ENTRY DATE: 2019-04-01
  ref <313>: RELEVANT RESIDUES IN SEQ ID NO: (1)..(1484)
aacctgagagtttgatcctggctcaggacgaacgctggcggcaggcttaacacatgcaagtcgaacgcatccttcggggtgagtggcagacgggtgagtaacgcgtgggaatctacctatctctacggaatagctccgggaaactggaattaataccgtatacgccggaaacgggaaagatttatcggggatagatgagcccgcgttggattagctagttggtggggtaatggcctaccaaggcgacgatccatagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggggacgataatgacggtacccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactggatgtcttgagtgtggaagaggtaagtggaattgcgagtgtagaggtgaaattcgtagatattcgcaggaacaccagtggcgaaggcggcttactggtccacaactgacgctgaggtgcgaaagcgtggggagcaaacaggattagataccctggtagtccacgccgtaaacgatggaagctagccgtcgggttgtttacagctcggtggcgcagctaacgcattaagcttcccgcctggggagtacggtcgcaagattaaaactcaaaggaattgacgggggcccgcacaagcggtggagcatgtggtttaattcgaagcaacgcgcagaaccttaccagcccttgacatgcccggctatccagagagatttggagttcccttcggggaccgggacacaggtgctgcatggctgtcgtcagctcgtgtcgtgagatgttgggttaagtcccgcaacgagcgcaaccctcgcccttagttgccatcattcagttgggcactctaaggggactgccggtgataagccgagaggaaggtggggatgacgtcaagtcctcatggcccttacgggctgggctacacacgtgctacaatggcggtgacaatgggcagcgagaccgcgaggtcgagctaatctccaaaaaccgtctcagttcggattgcactctgcaactcgggtgcatgaagttggaatcgctagtaatcgtggatcagcacgccacggtgaatacgttcccgggccttgtacacaccgcccgtcacaccatgggagttggttctacccgaaggtggtgcgctaacccgcaagggaggcagccaaccacggtagggtcagcgactggggtgaagtcgtaacaaggtagccgtaggggaacctgcggctggatcacctccttt

SEQ ID NO: 2931 - DNA, 1558 bp, Convivina intestini
  ref <308>: DATABASE ACCESSION NUMBER: NCBI ACCESSION: NZ_QEKT01000016.1
  ref <309>: DATABASE ENTRY DATE: 2019-04-01
  ref <313>: RELEVANT RESIDUES IN SEQ ID NO: (1)..(1558)
taacatgagagtttgatcctggctcaggatgaacgctggcggcgtgcctaatacatgcaagtcgaacgcacagcgaaaggtgcttgcacctttcaagtgagtggcgaacgggtgagtaacacgtgaataacctgccttatagtaggggataacatttggaaacagatgctaataccgtataaaacaactttttgcataaaaggttgttaaaaggcgcttcggcgtcgctaaaagatggattcgcgctgcattagttagttggtgaggtaaaggctcaccaagacgatgatgcatagccgagttgagagactgatcggccacattgggactgagacacggcccaaactcctacgggaggctgcagtagggaatcttccacaatgggcgcaagcctgatggagcaacgccgcgtgtgtgatgaaggctttcgggtcgtaaagcactgttgtatgggaagaatggcttaggtaggcaatgacctaagattgacggtaccataccagaaagggacggctaaatacgtgccagcagccgcggtaatacgtatgtcccgagcgttatccggatttattgggcgtaaagcgagcgcagacggttggttaagtctgaagtgaaagcccacagctcaactgtggaattgctttggaaactggctaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacaggattagataccctggtagtccacaccgtaaacgatgaatactaggtgttaggaggtttccgcctcttagtgccgcagcaaacgcattaagtattccgcctggggagtacgaccgcaaggttgaaactcaaaggaattgacggggacccgcacaagcggtggagcatgtggtttaattcgaagcaacgcgaagaaccttaccaggtcttgacatcctttgaagatgttagagataacattgtgctcttcggagccaaagtgacaggtggtgcatggtcgtcgtcagctcgtgtcgtgagatgttgggttaagtcccgcaacgagcgcaacccttattgttagttgccagcatttagttgggcactctagcgagactgccggtgacaaaccggaggaaggcggggacgacgtcagatcatcatgccccttatgacctgggctacacacgtgctacaatggcgtatacaacgagtcgcaaacccgcgagggcaagctaatctcttaaagtacgtctcagttcggattgtagtctgcaactcgactacatgaagtcggaatcgctagtaatcgcggatcagcatgccgcggtgaatacgttcccgggtcttgtacacaccgcccgtcacaccatgggagtttgtaatgcccaaagccggtggcctaaccttttggagggagccgtctaaggcaggacagatgactggggtgaagtcgtaacaaggtagccgtaggagaacctgcggctggatcacctcctttctaaggaa

SEQ ID NO: 2932 - DNA, 1532 bp, Coprobacillus cateniformis
  ref <308>: DATABASE ACCESSION NUMBER: NCBI ACCESSION: NZ_QSCY01000048.1
  ref <309>: DATABASE ENTRY DATE: 2019-04-01
  ref <313>: RELEVANT RESIDUES IN SEQ ID NO: (1)..(1532)
aatggagagtttgatcctggctcaggatgaacgctggcggcgtgcctaatacatgcaagtcgaacgcactgattttatcagtgagtggcgaacgggtgagtaatacataagtaacctgccctcatgagggggataactattagaaatgatagctaagaccgcataggtgaaggggtcgcatgaccgcttcattaaatatccgtatggatagcaggaggatggacttatggcgcattagctggttggtgaggtaacggctcaccaaggcgacgatgcgtagccgacctgagagggtggacggccacactgggactgagacacggcccagactcctacgggaggcagcagtagggaattttcggcaatgggggaaaccctgaccgagcaacgccgcgtgagggaagaagtatttcggtatgtaaacctctgttataaaggaagaacggtatgaataggaaatgattcataagtgacggtactttatgagaaagccacggctaactacgtgccagcagccgcggtaatacgtaggtggcgagcgttatccggaatcattgggcgtaaagagggagcaggcggcaatagaggtctgcggtgaaagcctgaagctaaacttcagtaagccgtggaaaccaaatagctagagtgcagtagaggatcgtggaattccatgtgtagcggtgaaatgcgtagatatatggaggaacaccagtggcgaaggcgacgatctgggctgcaactgacgctcagtcccgaaagcgtggggagcaaataggattagataccctagtagtccacgccgtaaacgatgagtactaagtgttgggggtcaaacctcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatacctctaaaggctctagagatagagagatagctataggggatacaggtggtgcatggttgtcgtcagctcgtgtcgtgagatgttgggttaagtcccgcaacgagcgcaacccttgtcgctagttaccatcattaagttggggactctagcgagactgcctctgcaaggaggaggaaggcggggatgacgtcaaatcatcatgccccttatgacctgggctacacacgtgctacaatggacggatcaaagggaagcgaagccgcgaggtggagcgaaacccaaaaacccgttctcagttcggactgcagtctgcaactcgactgcacgaagttggaatcgctagtaatcgcgaatcagaatgtcgcggtgaatacgttctcgggccttgtacacaccgcccgtcacaccatgagagttggtaacacccgaagccggtggcttaaccgcaaggagagagctgtctaaggtgggactgatgattagggtgaagtcgtaacaaggtatccctacgggaacgtggggatggatcacctcctttctagggaga

SEQ ID NO: 2933 - DNA, 1527 bp, Coprobacillus sp. AF09-1A
  ref <308>: DATABASE ACCESSION NUMBER: NCBI ACCESSION: NZ_QUHU01000023.1
  ref <309>: DATABASE ENTRY DATE: 2019-04-01
  ref <313>: RELEVANT RESIDUES IN SEQ ID NO: (1)..(1527)
aatggagagtttgatcctggctcaggatgaacgctggcggcgtgcctaatacatgcaagtcgaacgcgagcacttgtgctcgagtggcgaacgggtgagtaatacataagtaacctgccctagacagggggataactattggaaacgatagctaagaccgcataggtacggacactgcatggtgaccgtattaaaagtgcctcaaagcactggtagaggatggacttatggcgcattagctggttggcggggtaacggcccaccaaggcgacgatgcgtagccgacctgagagggtgaccggccacactgggactgagacacggcccagactcctacgggaggcagcagtagggaattttcggcaatgggggaaaccctgaccgagcaacgccgcgtgaaggaagaaggttttcggattgtaaacttctgttataaaggaagaacggcggctacaggaaatggtagccgagtgacggtactttattagaaagccacggctaactacgtgccagcagccgcggtaatacgtaggtggcaagcgttatccggaattattgggcgtaaagagggagcaggcggcagcaagggtctgtggtgaaagcctgaagcttaacttcagtaagccatagaaaccaggcagctagagtgcaggagaggatcgtggaattccatgtgtagcggtgaaatgcgtagatatatggaggaacaccagtggcgaaggcgacgatctggcctgcaactgacgctcagtcccgaaagcgtggggagcaaataggattagataccctagtagtccacgccgtaaacgatgagtactaagtgttggatgtcaaagttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatactcataaaggctccagagatggagagatagctatatgagatacaggtggtgcatggttgtcgtcagctcgtgtcgtgagatgttgggttaagtcccgcaacgagcgcaacccttatcgttagttaccatcattaagttggggactctagcgagactgccagtgacaagctggaggaaggcggggatgacgtcaaatcatcatgccccttatgacctgggctacacacgtgctacaatggatggtgcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccacgagagttgataacacccgaagccggtggcctaaccgcaaggaaggagctgtctaaggtgggattgatgattggggtgaagtcgtaacaaggtatccctacgggaacgtggggatggatcacctcctttct

SEQ ID NO: 2934 - DNA, 1497 bp, Coprococcus catus
  ref <308>: DATABASE ACCESSION NUMBER: NCBI ACCESSION: NZ_QVFD01000001.1
  ref <309>: DATABASE ENTRY DATE: 2019-04-01
  ref <313>: RELEVANT RESIDUES IN SEQ ID NO: (1)..(1497)
aaacatgagagtttgatcctggctcaggatgaacgctggcggcgtgcttaacacatgcaagtcgaacggacgatgaagagcttgcttttcaaagttagtggcggacgggtgagtaacgcgtgggtaacctgcctcatacagggggatagcagctggaaacggctgataaaaccgcataagcgcacagcatcgcatgatgcagtgtgaaaaactccggtggtatgagatggacccgcgtctgattagcttgttggtgaggtaacggcccaccaaggcgacgatcagtagccggcctgagagggtgaccggccacattgggactgagacacggcccaaactcctacgggaggcagcagtggggaatattgcacaatgggggaaaccctgatgcagcgacgccgcgtgaaggaagaagtatctcggtatgtaaacttctatcagcagggaagataatgacggtacctgactaagaagccccggctaactacgtgccagcagccgcggtaatacgtagggggcaagcgttatccggatttactgggtgtaaagggagcgtaggcggcggagcaagtcagaagtgaaagcccggggctcaaccccgggacggcttttgaaactgccctgcttgatttcaggagaggtaagcggaattcctagtgtagcggtgaaatgcgtagatattaggaggaacaccagtggcgaaggcggcttactggactgacaatgacgctgaggctcgaaagcgtggggagcaaacaggattagataccctggtagtccacgccgtaaacgatgaatactaggtgtcgggggtcataagactttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggccttgacatcccggtgaccgtcccgtaatggggacctctcttcggagcaccggtgacaggtggtgcatggttgtcgtcagctcgtgtcgtgagatgttgggttaagtcccgcaacgagcgcaacccctatgttcagtagccagcaggtaaggctgggcactctggacagactgccggggataacccggaggaaggcggggatgacgtcaaatcatcatgccccttacggcctgggctacacacgtgctacaatggcgtaaacaaagggaagcgagagggtgacctggagcgaatcccaaaaataacgtcccagttcggactgtagtctgcaacccgactacacgaagctggaatcgctagtaatcgcgaatcagcatgtcgcggtgaatacgttcccgggtcttgtacacaccgcccgtcacaccatgggagttggaaatgcccgaagtcagtgacctaaccgcaagggaggagctgccgaaggtggagccgatgactggggtgaagtcgtaacaaggtagccgtatcggaagg

SEQ ID NO: 2935 - DNA, 1537 bp, Coprococcus comes
  ref <308>: DATABASE ACCESSION NUMBER: NCBI ACCESSION: NZ_QRIM01000021.1
  ref <309>: DATABASE ENTRY DATE: 2019-04-01
  ref <313>: RELEVANT RESIDUES IN SEQ ID NO: (1)..(1537)
tttaacgagagtttgatcctggctcaggatgaacgctggcggcgtgcttaacacatgcaagtcgaacgaagcacttatctttgattcttcggatgaagaggtttgtgactgagtggcggacgggtgagtaacgcgtgggtaacctgcctcatacagggggataacagttagaaatgactgctaataccgcataagaccacagagccgcatggctcagtgggaaaaactccggtggtatgagatggacccgcgtctgattaggtagttggtggggtaacggcctaccaagccaacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaaaatgacggtacctgactaagaagcaccggctaaatacgtgccagcagccgcggtaatacgtatggtgcaagcgttatccggatttactgggtgtaaagggagcgtagacggctgtgtaagtctgaagtgaaagcccggggctcaaccccgggactgctttggaaactatgcagctagagtgtcggagaggtaagtggaattcccagtgtagcggtgaaatgcgtagatattgggaggaacaccagtggcgaaggcggcttactggacgatgactgacgttgaggctcgaaagcgtggggagcaaacaggattagataccctggtagtccacgccgtaaacgatgactactaggtgtcggggagcaaagctcttcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgctcttgacatcccggtgaccggcgtgtaatgacgccttttcttcggaacaccggtgacaggtggtgcatggttgtcgtcagctcgtgtcgtgagatgttgggttaagtcccgcaacgagcgcaacccttatcttcagtagccagcattttggatgggcactctggagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaagg

SEQ ID NO: 2936 - DNA, 1526 bp, Coprococcus sp. AF16-22
  ref <308>: DATABASE ACCESSION NUMBER: NCBI ACCESSION: NZ_QTXH01000007.1
  ref <309>: DATABASE ENTRY DATE: 2019-04-01
  ref <313>: RELEVANT RESIDUES IN SEQ ID NO: (1)..(1526)
tttaatgagagtttgatcctggctcaggatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacggtgtcgcatgacacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctggagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaaggaactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgacggttccttaaccggaacttttcttcggaacatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcaaacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgtaaggagggagctgccgaaggcaggatcgataactggggtgaagtcgtaacaaggtagccgtatcggaaggtgcggctggatcacctcctttctaaggaa

SEQ ID NO: 2937 - DNA, 1526 bp, Coprococcus sp. AF16-5
  ref <308>: DATABASE ACCESSION NUMBER: NCBI ACCESSION: NZ_QUGZ01000002.1
  ref <309>: DATABASE ENTRY DATE: 2019-04-01
  ref <313>: RELEVANT RESIDUES IN SEQ ID NO: (1)..(1526)
tttaatgagagtttgatcctggctcaggatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacggtgtcgcatgacacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctggagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaaggaactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgaccgttccttaaccggaacttttcttcggaacatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcaaacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgcaaggagggagctgccgaaggcaggatcgataactggggtgaagtcgtaacaaggtagccgtatcggaaggtgcggctggatcacctcctttctaaggaa

SEQ ID NO: 2938 - DNA, 1526 bp, Coprococcus sp. AF19-8AC; identical to SEQ ID NO: 2937
  ref <308>: DATABASE ACCESSION NUMBER: NCBI ACCESSION: NZ_QTMI01000002.1
  ref <309>: DATABASE ENTRY DATE: 2019-04-01
  ref <313>: RELEVANT RESIDUES IN SEQ ID NO: (1)..(1526)

SEQ ID NO: 2939 - DNA, 1526 bp, Coprococcus sp. AF38-1
  ref <308>: DATABASE ACCESSION NUMBER: NCBI ACCESSION: NZ_QVGO01000012.1
  ref <309>: DATABASE ENTRY DATE: 2019-04-01
  ref <313>: RELEVANT RESIDUES IN SEQ ID NO: (1)..(1526)
tttaatgagagtttgatcctggctcaggatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacggtatcgcatgatacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctggagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaaggaactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgaccgttccttaaccggaacttttcttcggaacatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcaaacctgtgaaggtgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgcaaggagggagctgccgaaggcaggatcgataactggggtgaagtcgtaacaaggtagccgtatcggaaggtgcggctggatcacctcctttctaaggaa

SEQ ID NO: 2940 - DNA, 1526 bp, Coprococcus sp. AM14-16
  ref <308>: DATABASE ACCESSION NUMBER: NCBI ACCESSION: NZ_QTLL01000001.1
  ref <309>: DATABASE ENTRY DATE: 2019-04-01
  ref <313>: RELEVANT RESIDUES IN SEQ ID NO: (1)..(1526)
tttaatgagagtttgatcctggctcaggatgaacgctggcggcgtgcttaacacatgcaagtcgaacgattgaagctggagcttgctccggccgatttagtggcggacgggtgagtaacgcgtgggtaacctgcctcatacagggggatagcagttggaaacgactggtaaaaccgcataagcgcacggtgtcgcatgacacagtgtgaaaacactccggtggtatgagatggacccgcgtctgattagctagttggtgaggtaacggcccaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagataatgacggtacctgactaagaagcaccggctaaatacgtgccagcagccgcggtaatacgtatggtgcaagcgttatccggatttactgggtgtaaagggtgcgtaggtggcaaggcaagtctgaagtgaaaatccggggctcaaccccggaactgctttggaaactgtttagctggagtacaggagaggtaagtggaattcctagtgtagcggtgaaatgcgtagatattaggaggaacaccagtggcgaaggcgacttactggactgctactgacactgaggcacgaaagcgtggggagcaaacaggattagataccctggtagtccacgccgtaaacgatgaatactaggtgttgggttccaaagggactcggtgccgtcgcaaacgcattaagtattccacctggggagtacgttcgcaagaatgaaactcaaaggaattgacggggacccgcacaagcggtggagcatgtggtttaattcgaagcaacgcgaaaaaccttaccaagtcttgacatcctgatgaccgttccttaaccggaacttttcttcggaacatcagagacaggtggtgcatggttgtcgtcagctcgtgtcgtgagatgttgggttaagtcccgcaacgagcgcaacccctatttccagtagccagcagtaagatgggcactctggagagactgccggggataacccggaggaaggtggggatgacgtcaaatcatcatgccccttatgatttgggctacacacgtgctacaatggcagttacaaagagaagcaaacctgtgaaggcgagcaaacctcaaaaaggctgtctcagttcggattgtagtctgcaactcgactacatgaagctggaatcgctagtaatcgcagatcagcatgctgcggtgaatacgttcccgggtcttgtacacaccgcccgtcacaccatgggagtcggtaacgcccgaagtcagtgacccaaccgtaaggagggagctgccgaaggcaggatcgataactggggtgaagtcgtaacaaggtagccgtatcggaaggtgcggctggatcacctcctttctaaggaa

SEQ ID NO: 2941 - DNA, 1526 bp, Coprococcus sp. OM06-34AC; identical to SEQ ID NO: 2937
  ref <308>: DATABASE ACCESSION NUMBER: NCBI ACCESSION: NZ_QTZF01000017.1
  ref <309>: DATABASE ENTRY DATE: 2019-04-01
  ref <313>: RELEVANT RESIDUES IN SEQ ID NO: (1)..(1526)

SEQ ID NO: 2942 - DNA, 1557 bp, Coraliomargarita akajimensis
  ref <308>: DATABASE ACCESSION NUMBER: NCBI ACCESSION: NC_014008.1
  ref <309>: DATABASE ENTRY DATE: 2019-04-01
  ref <313>: RELEVANT RESIDUES IN SEQ ID NO: (1)..(1557)
ttcggagagtttgatcctggctcagagtgaacgctggcggcgtggttaagacatgcaagtcgaacgggattgtttaagttgacgcttcggttgattcttaaacatgagagtggcaaacgggtgcgtaacacgtaagcaacctgccctaaagtttgggatagctcgaggaaactcgaattaataccggatgtggctcggtaactcatgttactagagctaaagcttgagatggcgctttaggaggggcttgcggcctatcagcttgttggtgaggtaatggctcaccaaggcaaagacgggtagctggtctgagaggatgatcagccacactggaactgagacacggtccagacacctacgggtggcagcagtttcgaatcattcacaatgggggaaaccctgatggtgcaacgccgcgtgggggatgacggccttcgggttgtaaacctctgtcaccaaggagcaacaagcaggttcatagcctgccctgagttaacttggagaggaagcagtggctaactccgtgccagcagccgcggtaatacggagactgcaagcgttactcggattcactgggcgtaaagggtgcgtaggccgctaagcgtgtcgggtgtgaaatctcggggctcaacctcgaaactgcgcccgaaactgtttagctagagtgtcggagaggtaagcggaattccaggtgtagcggtgaaatgcgtagatatctggaggaacaccaatggcgaaggcagcttactggacgacaactgacgctgaggcacgaaagcatgggtagcgaaagggattagatacccctgtagtccatgccgtaaacgttgtacactaggtcttgggggtttcgaccccttcaggaccccagctaacgcgataagtgtaccgcctgaggactacggccgcaaggctaaaactcaaaggaattgacgggggcccgcacaagcggtggagcatgtggcttaattcgatgcaacgcgaagaaccttacctaggcttgacatctataggacggtttccagagatggattcttcccttcggggcttatagacaggtgctgcatggccgtcgtcagctcgtgtcgtgagatgtttggttaagtccagcaacgagcgcaaccctcgtccttagttgccagcacgtaatggtggggactctaaggagacaaacttctttcagaagtgggaaggtggggatgacgtcaggtcagtatggcccttacgcctagggctgcacacgtgctacaatgcccggtacagtgggacgcaataccgcgaggtggagcaaatcctcaaaaccgggcccagttcggattggagtctgcaactcgactccatgaagtcggaatcgctagtaatgacgtatcagctacgacgtcgtgaatacgttcccgggccttgtacacaccgcccgtcacatcatgaaagccggttctgcccgaagtacgtgagttaacttcggagacagcgtcctaaggtagggctggtgattgggatgaagtcgtaacaaggtagccgtaggggaacctgcggctggatcacctcctttctaag

SEQ ID NO: 2943 - DNA, 1557 bp, Coraliomargarita sp. WN38
  ref <308>: DATABASE ACCESSION NUMBER: NCBI ACCESSION: NZ_QHJQ01000007.1
  ref <309>: DATABASE ENTRY DATE: 2019-04-01
  ref <313>: RELEVANT RESIDUES IN SEQ ID NO: (1)..(1557)
ttcggagagtttgatcctggctcagagtgaacgctggcggcgtggttaagacatgcaagtcgaacgagattgttcttattgaagcttcggtggaaatttgaacatgagagtggcaaacgggtgcgtaacacgtgagcaacctgccttaaagtttgggatagctcggggaaactcgaattaataccggatgtggcacgctaactcatgttagcagtgctaaagcttgtaatggcgctttaagaggggctcgcggcctatcagcttgttggtgaggtaaaggctcaccaaggctaagacgggtagctggtctgagaggatgatcagccacactggaactgagacacggtccagacacctacgggtggcagcagtttcgaatcattcacaatgggggcaaccctgatggtgcaacgccgcgtgagggatgaaggccttagggtcgtaaacctctgtcaccaaggagcaacaagcaggttcatagcctgccctgagttaacttggagaggaagcagtggctaactccgtgccagcagccgcggtaatacggagactgcaagcgttactcggattcactgggcgtaaagggtgcgtaggccgctaagcgtgtcaggtgtgaaatctcggggctcaacctcgaaactgcgcctgaaactgtttagcttgagtattggagaggtaagcggaatttctggtgtagcggtgaaatgcgtagatatcagaaggaacaccaatggcgaaggcagcttactggacaataactgacgctgaggcacgaaagcgtgggtagcgaaagggattagatacccctgtagtccacgccgtaaacgttgtacactaggtcttgggggtttcgaccccttcaggacccaagctaacgcgataagtgtaccgcctgaggactacggccgcaaggctaaaactcaaaggaattgacgggggcccgcacaagcggtggagcatgtggtttaattcgatgcaacgcgaagaaccttacctaggcttgacatgtatcggacggtttccagagatggattctttccttcgggactgatacacaggtgctgcatggccgtcgtcagctcgtgtcgtgagatgtttggttaagtccagcaacgagcgcaaccctcgtccttagttgccagcacgttatggtggggactctaaggagacaaacttctttcagaagtgggaaggtggggatgacgtcaggtcagtatggcccttacgcctagggctacacacgtgctacaatgcccggtacagtgggacgcaataccgcgaggtggagcaaatcctcaaaaccgggcccagttcggattggagtctgcaactcgactccatgaagtcggaatcgctagtaatgacgtatcagcaatgacgtcgtgaatacgttcccgggccttgtacacaccgcccgtcacatcatgaaagccggttttgcccgaagtatgtgcgctaacttcggaagcagcatcctaaggcagggctggtgattgggatgaagtcgtaacaaggtagccgtaggggaacctgcggctggatcacctcctttctaag

SEQ ID NO: 2944 - DNA, 1541 bp, Corallococcus coralloides
  ref <308>: DATABASE ACCESSION NUMBER: NCBI ACCESSION: NZ_CP034669.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtttcttcggagactgagggaaaaggtggcctctgtatacaagctatcacaaccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggagccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggaggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2945 - DNA, 1541 bp, Corallococcus sp. AB004
  ref <308>: DATABASE ACCESSION NUMBER: NCBI ACCESSION: NZ_RAWS01000464.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtttcttcggagactgagggaaaaggtggcctctgtatacaagctatcacaaccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2946 - DNA, 1541 bp, Corallococcus sp. AB011P
  ref <308>: DATABASE ACCESSION NUMBER: NCBI ACCESSION: NZ_RAVX01000052.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtttcttcggagactgagggaaaaggtggcctctgtatacaagctatcacaaccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggaggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2947 - DNA, 1541 bp, Corallococcus sp. AB018; identical to SEQ ID NO: 2945
  ref <308>: DATABASE ACCESSION NUMBER: NCBI ACCESSION: NZ_RAWR01000360.1
  ref <309>: DATABASE ENTRY DATE: 2019-04-01
  ref <313>: RELEVANT RESIDUES IN SEQ ID NO: (1)..(1541)

SEQ ID NO: 2948 - DNA, 1541 bp, Corallococcus sp. AB030; identical to SEQ ID NO: 2945
  ref <308>: DATABASE ACCESSION NUMBER: NCBI ACCESSION: NZ_RAWQ01000343.1
  ref <309>: DATABASE ENTRY DATE: 2019-04-01
  ref <313>: RELEVANT RESIDUES IN SEQ ID NO: (1)..(1541)

SEQ ID NO: 2949 - DNA, 1541 bp, Corallococcus sp. AB032C; identical to SEQ ID NO: 2945
  ref <308>: DATABASE ACCESSION NUMBER: NCBI ACCESSION: NZ_RAWP01000211.1
  ref <309>: DATABASE ENTRY DATE: 2019-04-01
  ref <313>: RELEVANT RESIDUES IN SEQ ID NO: (1)..(1541)

SEQ ID NO: 2950 - DNA, 1541 bp, Corallococcus sp. AB038B; identical to SEQ ID NO: 2945
  ref <308>: DATABASE ACCESSION NUMBER: NCBI ACCESSION: NZ_RAWO01000035.1
  ref <309>: DATABASE ENTRY DATE: 2019-04-01
  ref <313>: RELEVANT RESIDUES IN SEQ ID NO: (1)..(1541)

SEQ ID NO: 2951 - DNA, 1541 bp, Corallococcus sp. AB043A
  ref <308>: DATABASE ACCESSION NUMBER: NCBI ACCESSION: NZ_RAVW01000760.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtctcttcggagactgagggaaaaggtggcctctgtatacaagctatcacaaccagatgagtccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaacccgaaggctaacatccttcggcttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcacctcaccaagaggtgcccaaggagtgctcggtaactggggtgaagtcgtaacaaggtagccgtaggggaacctgcggctggatcacctcctttcta

SEQ ID NO: 2952 - DNA, 1541 bp, Corallococcus sp. AB045; identical to SEQ ID NO: 2946
  ref <308>: DATABASE ACCESSION NUMBER: NCBI ACCESSION: NZ_RAWN01000336.1
  ref <309>: DATABASE ENTRY DATE: 2019-04-01
  ref <313>: RELEVANT RESIDUES IN SEQ ID NO: (1)..(1541)

SEQ ID NO: 2953 - DNA, 1541 bp, Corallococcus sp. AB047A
  ref <308>: DATABASE ACCESSION NUMBER: NCBI ACCESSION: NZ_RAWM01000233.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtctcttcggagactgagggaaaaggtggcctctgtatacaagctatcacaaccagatgagtccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2954 - DNA, 1455 bp, Corallococcus sp. AB049A
  ref <308>: DATABASE ACCESSION NUMBER: NCBI ACCESSION: NZ_RAWL01000779.1
  ref <309>: DATABASE ENTRY DATE: 2019-04-01
  ref <313>: RELEVANT RESIDUES IN SEQ ID NO: (1)..(1455)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtctcttcggagactgagggaaaaggtggcctctgtatacaagctatcacaaccagatgagtccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcatctcaccaag

SEQ ID NO: 2955 - DNA, 1541 bp, Corallococcus sp. AB050A
  ref <308>: DATABASE ACCESSION NUMBER: NCBI ACCESSION: NZ_RAWK01000416.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtttcttcggagactgagggaaaaggtggcctctgtatacaagctatcacaaccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaacccgaaggctaacatccttcggcttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggaggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2956 - DNA, 1541 bp, Corallococcus sp. AB050B
  ref <308>: DATABASE ACCESSION NUMBER: NCBI ACCESSION: NZ_RAWJ01000293.1
  ref <309>: DATABASE ENTRY DATE: 2019-04-01
  ref <313>: RELEVANT RESIDUES IN SEQ ID NO: (1)..(1541)
taattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtctcttcggagactgagggaaaaggtggcctctgtatacaagctatcacaaccagatgagtccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2957 - DNA, 1539 bp, Corallococcus sp. CA031B
  ref <308>: DATABASE ACCESSION NUMBER: NCBI ACCESSION: NZ_RAWI01000495.1
  ref <309>: DATABASE ENTRY DATE: 2019-04-01
  ref <313>: RELEVANT RESIDUES IN SEQ ID NO: (1)..(1539)
caattggagagtttgatcctggctcagaacgaacgctggcggcgtgcctaacacatgcaagtcgagcgcgaatggggcaaccctagtagagcggcgcacgggtgcgtaacacgtggataatctgcctggatgcctgggataaccagtcgaaagattggctaataccggataagcccacggtttcttcggagactgagggaaaaggtggcctctgtatacaagctatcacaaccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaacccgaagcctaatacgcttcggcttgacggtaccgggagaagaagcaccggctaactctgtgccagcagccgcggtaatacagagggtgcaagcgttgttcggaattattgggcgtaaagcgcgcgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgaggcgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcgaaatccttcagagatgagggagtgcccgcaagggaatcgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcacctcaccaagaggtgcccaaggagtgctcggtaactggggtgaagtcgtaacaaggtagccgtaggggaacctgcggctggatcacctcctttcta

SEQ ID NO: 2958 - DNA, 1556 bp, Corallococcus sp. CA031C; identical to SEQ ID NO: 234
  ref <308>: DATABASE ACCESSION NUMBER: NCBI ACCESSION: NZ_RAWH01000128.1
  ref <309>: DATABASE ENTRY DATE: 2019-04-01
  ref <313>: RELEVANT RESIDUES IN SEQ ID NO: (1)..(1556)

SEQ ID NO: 2959 - DNA, 1539 bp, Corallococcus sp. CA040B
  ref <308>: DATABASE ACCESSION NUMBER: NCBI ACCESSION: NZ_RAWG01000520.1
  ref <309>: DATABASE ENTRY DATE: 2019-04-01
  ref <313>: RELEVANT RESIDUES IN SEQ ID NO: (1)..(1539)
caattggagagtttgatcctggctcagaacgaacgctggcggcgtgcctaacacatgcaagtcgagcgcgaatggggaaaccctagtagagcggcgcacgggtgcgtaacacgtggataatctgcctggatgcctgggataaccagtcgaaagattggctaataccggataagcccacgatttcttcggagattgagggaaaaggtggcctctgtatacaagctatcacatccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaacccgaagcctaatacgcttcggcttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcgaaatccttcagagatgagggagtgcccgcaagggaatcgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcacctcaccaagaggtgcccaaggagtgctcggtaactggggtgaagtcgtaacaaggtagccgtaggggaacctgcggctggatcacctcctttcta

SEQ ID NO: 2960 - DNA, 1541 bp, Corallococcus sp. CA041A; identical to SEQ ID NO: 2945
  ref <308>: DATABASE ACCESSION NUMBER: NCBI ACCESSION: NZ_RAWF01000396.1
  ref <309>: DATABASE ENTRY DATE: 2019-04-01
  ref <313>: RELEVANT RESIDUES IN SEQ ID NO: (1)..(1541)

SEQ ID NO: 2961 - DNA, 1541 bp, Corallococcus sp. CA043D
  ref <308>: DATABASE ACCESSION NUMBER: NCBI ACCESSION: NZ_RAWE01000356.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtctcttcggagactgagggaaaaggtggcctctgtatacaagctatcacaaccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaacccgaaggctaacatccttcggcttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2962 - DNA, 1539 bp, Corallococcus sp. CA047B; identical to SEQ ID NO: 2957
  ref <308>: DATABASE ACCESSION NUMBER: NCBI ACCESSION: NZ_RAWD01000455.1
  ref <309>: DATABASE ENTRY DATE: 2019-04-01
  ref <313>: RELEVANT RESIDUES IN SEQ ID NO: (1)..(1539)

SEQ ID NO: 2963 - DNA, 1541 bp, Corallococcus sp. CA049B
  ref <308>: DATABASE ACCESSION NUMBER: NCBI ACCESSION: NZ_RAWC01000345.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaatgggggcaacccttagtagagcggcgcacgggtgcgtaacacgtggataatctgcctggatgcctgggataaccagtcgaaagattggctaataccggataagcccacggtttcttcggagactgagggaaaaggtggcctctgtatacaagctatcacaaccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggaggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2964 - DNA, 1539 bp, Corallococcus sp. CA051B
  ref <308>: DATABASE ACCESSION NUMBER: NCBI ACCESSION: NZ_RAWB01000596.1
  ref <309>: DATABASE ENTRY DATE: 2019-04-01
  ref <313>: RELEVANT RESIDUES IN SEQ ID NO: (1)..(1539)
caattggagagtttgatcctggctcagaacgaacgctggcggcgtgcctaacacatgcaagtcgagcgcgaatggggaaaccctagtagagcggcgcacgggtgcgtaacacgtggataatctgcctggatgtctgggataaccagtcgaaagattggctaataccggataagcccacgatttcttcggagattgagggaaaaggtggcctctgtatacaagctatcacatccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaacccgaagcctaatacgcttcggcttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcgaaatccttcagagatgagggagtgcccgcaagggaatcgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcacctcaccaagaggtgcccaaggagtgctcggtaactggggtgaagtcgtaacaaggtagccgtaggggaacctgcggctggatcacctcctttcta

SEQ ID NO: 2965 - DNA, 1539 bp, Corallococcus sp. CA053C
  ref <308>: DATABASE ACCESSION NUMBER: NCBI ACCESSION: NZ_RAWA01000528.1
  ref <309>: DATABASE ENTRY DATE: 2019-04-01
  ref <313>: RELEVANT RESIDUES IN SEQ ID NO: (1)..(1539)
caattggagagtttgatcctggctcagaacgaacgctggcggcgtgcctaacacatgcaagtcgagcgcgaatggggaaaccctagtagagcggcgcacgggtgcgtaacacgtggataatctgcctggatgcctgggataaccagtcgaaagattggctaataccggataagcccacgatttcttcggagattgagggaaaaggtggcctctgtatacaagctatcacatccagatgagtccgcggcccatcagctagttggcggggtaatggcccaccaaggcaacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaacccggagtctaatacgctccggcttgacggtaccgggagaagaagcaccggctaactctgtgccagcagccgcggtaatacagagggtgcaagcgttgttcggaattattgggcgtaaagcgcgcgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgaggcgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcgaaatccttcagagatgagggagtgcccgcaagggaatcgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcacctcaccaagaggtgcccaaggagtgctcggtaactggggtgaagtcgtaacaaggtagccgtaggggaacctgcggctggatcacctcctttcta

SEQ ID NO: 2966 - DNA, 1539 bp, Corallococcus sp. CA054A; identical to SEQ ID NO: 2957
  ref <308>: DATABASE ACCESSION NUMBER: NCBI ACCESSION: NZ_RAVZ01000457.1
  ref <309>: DATABASE ENTRY DATE: 2019-04-01
  ref <313>: RELEVANT RESIDUES IN SEQ ID NO: (1)..(1539)

SEQ ID NO: 2967 - DNA, 1541 bp, Corallococcus sp. CA054B
  ref <308>: DATABASE ACCESSION NUMBER: NCBI ACCESSION: NZ_RAVY01000329.1
  ref <309>: DATABASE ENTRY DATE: 2019-04-01
  ref <313>: RELEVANT RESIDUES IN SEQ ID NO: (1)..(1541)
caattggagagtttgatcctggctcagaacgaacgctggcggcgtgcctaacacatgcaagtcgagcgcgaataggggcaacccttagtagagcggcgcacgggtgcgtaacacgtggataatctgcctggatgcctgggataaccagtcgaaagattggctaataccggataagcccacggtttcttcggagactgagggaaaaggtggcctctgtatacaagctatcacaaccagatgagtccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggacgaaaccgtaaagcctaatacgctttgccttgacggtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacaggattagataccctggtagtccacgccgtaaacgatgagaactaggtgtcgtgggagttgacccccgcggtgccgtagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatccttcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggaggaatcgctagtaatcgcagatcagcacgctgcggtgaatacgttcccgggccttgtacacaccgcccgtcacaccatgggagtcgattgctccagaagtcatctcaccaagagatgcccaaggagtgctcggtaactggggtgaagtcgtaacaaggtagccgtaggggaacctgcggctggatcacctcctttcta

SEQ ID NO: 2968 - DNA, 1540 bp, Corallococcus sp. H22C18031201
  ref <308>: DATABASE ACCESSION NUMBER: NCBI ACCESSION: NZ_QNUN01000048.1
  ref <309>: DATABASE ENTRY DATE: 2019-04-01
  ref <313>: RELEVANT RESIDUES IN SEQ ID NO: (1)..(1540)
caattggagagtttgatcctggctcagaacgaacgctggcggcgtgcctaacacatgcaagtcgagcgcgaatggggaaaccctagtagagcggcgcacgggtgcgtaacacgtgggtaatctgcctggatgcctgggataaccagtcgaaagactggctaataccggataagcccacggactcttcggagtctgagggaaaaggtggcctctgtatacaagctatcacattcagatgagcccgcggcccatcagctagttggcggggtaatggcccaccaaggcgacgacgggtagctggtctgagaggacgatcagccacactggaactgagacacggtccagactcctacgggaggcagcagtggggaattttgcgcaatgggcgaaagcctgacgcagcaacgccgcgtgtgtgatgaaggtctttggattgtaaagcactttcgaccgggaagaaaacccgtagcctaacatgctacggcttgactgtaccgggagaagaagcaccggctaactctgtgccagcagccgcggtaatacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggcaactgacgctgagacgcgaaagcgtggggagcaaacaggattagataccctggtagtccacgccgtaaacgatgagaactaggtgtcgtgggagttgacccccgcggtgccgaagctaacgcattaagttctccgcctgggaagtacggtcgcaagactaaaactcaaaggaattgacgggggcccgcacaagcggtggagcatgtggtttaattcgacgcaacgcgcagaaccttacctggtcttgacatcctcggaatctctcagagatgagggagtgcccgcaagggaaccgagagacaggtgctgcatggctgtcgtcagctcgtgtcgtgagatgttgggttaagtcccgcaacgagcgcaaccctcgcctttagttgccacgcaagtggatctctagagggactgccggtgttaaaccggaggaaggtggggatgacgtcaagtcctcatggcctttatgaccagggctacacacgtgctacaatggccggtacagagcgctgcaaacccgcgagggggagctaatcgcagaaaaccggtctcagttcagattggagtctgcaactcgactccatgaaggcggaatcgctagtaatcgcagatcagcacgctgcggtgaatacgttcccgggccttgtacacaccgcccgtcacaccatgggagtcgattgctccagaagtcatctcaccaagagatgcccaaggagtggtcggtaactggggtgaagtcgtaacaaggtagccgtaggggaacctgcggctggatcacctcctttctaa

SEQ ID NO: 2969 - DNA, 1539 bp, Corticibacter populi
  ref <308>: DATABASE ACCESSION NUMBER: NCBI ACCESSION: NZ_RDQO01000011.1
  ref <309>: DATABASE ENTRY DATE: 2019-04-01
  ref <313>: RELEVANT RESIDUES IN SEQ ID NO: (1)..(1539)
gaactaaagagtttgatcctggctcagattgaacgctggcggcatgctttacacatgcaagtcgaacggcagcacgggcttcggcctggtggcgagtggcgaacgggtgagtaatacatcggaacatacctggtagtgggggatagctcggcgaaagccggattaataccgcataagatctgaggatgaaagcaggggaccttcgggccttgcgctactggagtggccgatggcagattaggtagttggtggggtaaaggcccaccaagcctgcgatctgtagctggtctgagaggacgaccagccacactgggactgagacacggcccagactcctacgggaggcagcagtggggaattttggacaatgggcgcaagcctgatccagcaatgccgcgtgcaggatgaaggccttcgggttgtaaactgcttttgtacgggacgaaaagtctctggttaatacccggggatgatgacggtaccgtaagaataagcaccggctaactacgtgccagcagccgcggtaatacgtagggtgcgagcgttaatcggaattactgggcgtaaagcgtgcgcaggcggcgatgcaagaccgatgtgaaatccccgggctcaacctgggaactgcattagtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttggggattaatttcttcagtaacgaagctaacgcgtgaagttgaccgcctggggagtacggccgcaaggctaaaactcaaaggaattgacggggacccgcacaagcggtggatgatgtggtttaattcgatgcaacgcgaaaaaccttacccacctttgacatgtacggaatcctttagagatagaggagtgctcgaaagagagccgtaacacaggtgctgcatggctgtcgtcagctcgtgtcgtgagatgttgggttaagtcccgcaacgagcgcaacccttgtcattagttgccatcatttagttgggcactctaatgagactgccggtgataaaccggaggaaggtggggatgacgtcaagtcctcatggcccttataggtggggctacacacgtcatacaatggccggtacaaagggcagccaacccgcgagggggagctaatcccataaagccggtcgtagtccggatcgcagtctgcaactcgactgcgtgaagtcggaatcgctagtaatcgtggatcagcatgtcacggtgaatacgttcccgggtcttgtacacaccgcccgtcacaccatgggagcgggttctgccagaagtaggtagcttaaccgtaaggagggcgcttaccacggcagggctcgtgactggggtgaagtcgtaacaaggtagccgtatcggaaggtgcggctggatcacctcctttctg

SEQ ID NO: 2970 - DNA, 1528 bp, Corynebacterium-like bacterium B27
  ref <308>: DATABASE ACCESSION NUMBER: NCBI ACCESSION: NZ_BADC01000707.1
  ref <309>: DATABASE ENTRY DATE: 2019-04-01
  ref <313>: RELEVANT RESIDUES IN SEQ ID NO: (1)..(1528)
atttacggagagtttgatcctggctcaggacgaacgctggcggcgtgcttaacacatgcaagtcgaacggtgaaagaggagcttgctcctctggatcagtggcgaacgggtgagtaacacgtgagtaacctgcccttgactctgggataagcgttggaaacgacgtctaataccggatacgaaccgcgaaggcatcttctgcggttggaaagaatttcggtcaaggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcataggagactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgtggatcagcaacgccacggtgaatacgttcccgggccttgtacacaccgcccgtcaagtcatgaaagtcggtaacacccgaagccggtggcccaacccttgtggagggagccgtcgaaggtgggatcggtgattaggactaagtcgtaacaaggtagccgtaccggaaggtgcggctggatcacctcctttcta

SEQ ID NO: 2971 - DNA, 1529 bp, Corynebacterium accolens
  ref <308>: DATABASE ACCESSION NUMBER: NCBI ACCESSION: NZ_NWBP01000012.1
  ref <309>: DATABASE ENTRY DATE: 2019-04-01
  ref <313>: RELEVANT RESIDUES IN SEQ ID NO: (1)..(1529)
tttttttgtggagagtttgatcctggctcaggacgaacgctggcggcgtgcttaacacatgcaagtcgaacggaaaggcctcagcttgctggggtactcgagtggcgaacgggtgagtaacacgtgggtgatctgccttgcacttcgggataagcttgggaaactgggtctaataccggataggacagctgtttagtgtcagttgtggaaagttttttcggtgcaagatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcggaagcctgatgcagcgacgccgcgtgggggatgaaggccttcgggttgtaaactcctttcgacagggacgaagcttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggctgacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatagcggatcgctgcagagatgtagtttccctttgtggtcgttatacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccagtggctcaaactcgttagggagctgtcgaaggtgggatcggcgattgggacgaagtcgtaacaaggtagccgtaccggaaggtgcggctggatcacctcctttctaaggag

SEQ ID NO: 2972 - DNA, 1531 bp, Corynebacterium amycolatum
  ref <308>: DATABASE ACCESSION NUMBER: NCBI ACCESSION: NZ_UFXE01000003.1
  ref <309>: DATABASE ENTRY DATE: 2019-04-01
  ref <313>: RELEVANT RESIDUES IN SEQ ID NO: (1)..(1531)
tttgatggagggtttgatcctggctcaggacgaacgctggcggcgtgcttaacacatgcaagtcgaacggtaaggctccagcttgctggggtacacgagtggcgaacgggtgagtaacacgtgggtgacctgccctgcacttcgggataagcctggggaaactggggtctaataccggataggaccgcaccgtgagggtgtggtggaaagtttttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaagggtttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatggggagcgaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggatcgcgccagagatggtgtttcccttgtggcttgtatacaggtggtgcatggttgtcgtcagctcgtgtcgtgagatgttgggttaagtcccgcaacgagcgcaacccttgtcttatgttgccagcacgttgtggtggggactcgtaagaaactgccggggttaactcggaggaaggtggggatgacgtcaaatcatcatgccccttatgtccagggcttcacacatgctacaatggtcggtacagtgggttgccagtccgtgagggcgagctaatcccgcaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaaactcgttagggagctgtcgaaggtgggattggcgattgggacgaagtcgtaacaaggtagccgtaccggaaggtgcggctggatcacctcctttctaaggag

SEQ ID NO: 2973 - DNA, 1528 bp, Corynebacterium aurimucosum
  ref <308>: DATABASE ACCESSION NUMBER: NCBI ACCESSION: NZ_PNHI01000033.1
  ref <309>: DATABASE ENTRY DATE: 2019-04-01
  ref <313>: RELEVANT RESIDUES IN SEQ ID NO: (1)..(1528)
tttgtggagagtttgatcctggctcaggacgaacgctggcggcgtgcttaacacatgcaagtcgaacggaaaggcctcttgcttgcaaggggtactcgagtggcgaacgggtgagtaacacgtgggtgatctgccttgcactctgggataagcttgggaaactgggtctaataccggatatgagccgcttttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactagattgctgcagagatgtagtgtcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtacccgtaccggaaggtgcgggtggatcacctcctttctaaggag

SEQ ID NO: 2974 - DNA, 1519 bp, Corynebacterium bouchesdurhonense
  ref <308>: DATABASE ACCESSION NUMBER: NCBI ACCESSION: NZ_LT546028.1
  ref <309>: DATABASE ENTRY DATE: 2019-04-01
  ref <313>: RELEVANT RESIDUES IN SEQ ID NO: (1)..(1519)
gtttttgtggagagtttgatcctggctcaggatgaacgctggcggcgtgcttaacacatgcaagtcgaacggaaaggcctcagcttgctggggtactcgagtggcgaacgggtgagtaacacgtgggtgatctgccctgcacttcgggataagcttgggaaactgggtctaataccggataggaccatcgtgttgtggcggtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccaaagacgaattttgacggtatttggagaagaagcaccggctaactacgtgccagcagccgcggtaatacgtagggtgcgagcgttgtccggaattactgggcgtaaagagctcgtaggtggtttgtcgcgtcgtttgtggaataccgcagcttaactgtggggttgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgagcctgtgagggtgagcgaatcgcttaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcatgggagctgtcgaaggtgggatcggcgattgggacgaagtcgtaacaaggtagccgtaccggaaggtgcggctggatcacctcctttctaaggag

SEQ ID NO: 2975 - DNA, 1528 bp, Corynebacterium bovis
  ref <308>: DATABASE ACCESSION NUMBER: NCBI ACCESSION: NZ_PQNW01000014.1
  ref <309>: DATABASE ENTRY DATE: 2019-04-01
  ref <313>: RELEVANT RESIDUES IN SEQ ID NO: (1)..(1528)
ttttatggagagtttgatcctggctcaggacgaacgctggcggcgtgcttaacacatgcaagtcgaacggaaaggccccagcttgctggggtactcgagtggcgaacgggtgagtaacacgtgggtgatctgccctgcactctgggataagcctgggaaactgggtctaataccggataggaccgtgctttagtgtgtgcggtggaaagtttttcggtgcaggatgagcccgcggcctatcagcttgttggtggggtaatggcctaccaaggcggcgacgggtagccggcctgagagggtgtacggccacattgggactgagacacggcccagactcctacgggaggcagcagtggggaatattgcacaatgggcgcaagcctgatgcagcgacgccgcgtgggggatgacggccttcgggttgtaaacccctttcggcagggacgaagcttttgtgacggtacctgcataagaagcaccggctaactacgtgccagcagccgcggtaatacgtagggtgcgagcgttgtccggaattactgggcgtaaagagctcgtaggtggtttgtcgcgtcgtctgtgaaatcccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtggggatcttccacgatttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgggcaggaccggcgtggagacacgtcttcccttttgggcttgttcacaggtggtgcatggttgtcgtcagctcgtgtcgtgagatgttgggttaagtcccgcaacgagcgcaacccttgtcttgtgttgccagcacgtaatggtggggactcgcgagagactgccggggttaactcggaggaaggtggggatgacgtcaaatcatcatgccccttatgtccagggcttcacacatgctacaatggtcggtacagtgggttgcgatgccgcgaggctcagctaatcccttaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccggtggcccaaactcgttagggagccgtcgaaggtgggatcggcgattgggacgaagtcgtaacaaggtagccgtaccggaaggtgcggctggatcacctcctttctaaggag

SEQ ID NO: 2976 - DNA, 1533 bp, Corynebacterium choanis
  ref <308>: DATABASE ACCESSION NUMBER: NCBI ACCESSION: NZ_CP033896.1
  ref <309>: DATABASE ENTRY DATE: 2019-04-01
  ref <313>: RELEVANT RESIDUES IN SEQ ID NO: (1)..(1533)
tttaatggagagtttgatcctggctcaggacgaacgctggcggcgtgcttaacacatgcaagtcgaacggaaaggccctgcttgcagggtactcgagtggcgaacgggtgagtaacacgtgggtgatctgccccgcactccgggataagcctgggaaactgggtctaatactggatattcactgccttctaggtgggtagtggaaagttttttcggtgtgggatgagcctgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgagggatgacggccttcgggttgtaaacctctttcggcagggacgaagcgtaagtgacggtacctgcataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgctgtaaacggtgggcgctaggtgtgggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacacgagatcgctgcagagatgtagtttcccttgtggttcgtgtacaggtggtgcatggttgtcgtcagctcgtgtcgtgagatgttgggttaagtcccgcaacgagcgcaacccttgtcttatgttgccagcacgtgatggtggggactcatgagagactgccggggtcaactcggaggaaggtggggatgacgtcaaatcatcatgccccttatgtccagggcttcacacatgctacaatggtcggtacagcgcgctgcgagcctgtgagggtaagcgaatcgctttgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaccgtttttgcggggggagctgtcgaaggtgggatcggcgattgggacgaagtcgtaacaaggtagccgtaccggaaggtgcggctggatcacctcctttctaaggag

SEQ ID NO: 2977 - DNA, 1528 bp, Corynebacterium coyleae
  ref <308>: DATABASE ACCESSION NUMBER: NCBI ACCESSION: NZ_FNRU01000002.1
  ref <309>: DATABASE ENTRY DATE: 2019-04-01
  ref <313>: RELEVANT RESIDUES IN SEQ ID NO: (1)..(1528)
ttttttgtggagagtttgatcctggctcaggatgaacgctggcggcgtgcttaacacatgcaagtcgaacggaaaggcccaagcttgcttgggtactcgagtggcgaacgggtgagtaacacgtgggtgatctgccccgcacttcgggataagcctgggaaactgggtctaataccggataggaccacttcttggaggttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagcgttatgtgacggtacctagagaagaagcaccggctaactacgtgccagcagccgcggtaatacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagaccgggccagagatggtctttccctttgtggttggtgtacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgtttgcgagcctgtgagggtgtgctaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcatgggagctgtcgaaggtgggatcggcgattgggacgaagtcgtaacaaggtagccgtaccggaaggtgcggctggatcacctcctttctaaggag

SEQ ID NO: 2978 - DNA, 1528 bp, Corynebacterium diphtheriae
  ref <308>: DATABASE ACCESSION NUMBER: NCBI ACCESSION: NZ_LR134537.1
  ref <309>: DATABASE ENTRY DATE: 2019-04-01
  ref <313>: RELEVANT RESIDUES IN SEQ ID NO: (1)..(1528)
tttatggagagtttgatcctggctcaggacgaacgctggcggcgtgcttaacacatgcaagtcgaacggaaaggcctagcttgctaggtactcgagtggcgaacgggtgagtaacacgtgggtgatctgcctcgtacttcgggataagcctgggaaactgggtctaatactggataggaccatgctttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaacctctttcgctagggacgaagcttttgtgacggtacctagataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatcagcaggatcgccgcagagatgtggtttcccttgtggtctgttgacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgctgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaacccttgtgggggggagctgtcgaaggtgggatcggcgattgggacgaagtcgtaacaaggtagccgtaccggaaggtgcggctggatcacctcctttctaaggag

SEQ ID NO: 2979 - DNA, 1532 bp, Corynebacterium falsenii
  ref <308>: DATABASE ACCESSION NUMBER: NCBI ACCESSION: NZ_QXJK01000025.1
  ref <309>: DATABASE ENTRY DATE: 2019-04-01
  ref <313>: RELEVANT RESIDUES IN SEQ ID NO: (1)..(1532)
tttatggagagtttgatcctggctcaggacgaacgctggcggcgtgcttaacacatgcaagtcgaacggaaaggcccttgcttgcaggggtactcgagtggcgaacgggtgagtaacacgtgggtgatctgccttgtacttcgggataagcctgggaaactgggtctaataccggataggaccatgctttagtgtgtgtggtggaaagttttttcggtacaagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcgcaagcctgatgcagcgacgccgcgtgagggatgacggccttcgggttgtaaacctctttcgctagggaagaagccacttgtggtgacggtacctggataagaagcaccggctaactacgtgccagcagccgcggtaatacgtagggtgcaagcgttgtccggaattactgggcgtaaagagctcgtaggtggtttgtcgcgtcgtctgtgaaatcccggggcttaactccgggcgtgcaggcgatacgggcataactggagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtggggatctttctacgatttccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcgctgcagagatgtagtttcccttgtggtctgtatacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagagggtcgcgataccgtgaggtggagctaatccctgaaagccggtctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgggacgaagtcgtaacaaggtagccgtaccggaaggtgcggctggatcacctcctttctaaggag

SEQ ID NO: 2980 - DNA, 1526 bp, Corynebacterium fournierii
  ref <308>: DATABASE ACCESSION NUMBER: NCBI ACCESSION: NZ_LT839618.1
  ref <309>: DATABASE ENTRY DATE: 2019-04-01
  ref <313>: RELEVANT RESIDUES IN SEQ ID NO: (1)..(1526)
tttgtggagagtttgatcctggctcaggatgaacgctggcggcgtgcttaacacatgcaagtcgaacggaaaggcccaagcttgcttgggtactcgagtggcgaacgggtgagtaacacgtgggtgatctgccctgcacttcgggataagcctgggaaactgggtctaataccggataggaccacttcttggatgttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagcgtttttgtgacggtacctggagaagaagcaccggctaactacgtgccagcagccgcggtaatacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcaccagatcgctacagagatgtagtttccctttgtggttggtgtacaggtggtgcatggttgtcgtcagctcgtgtcgtgagatgttgggttaagtcccgcaacgagcgcaacccttgtcttatgttgccagcacgttatggtggggactcgtgagagactgccggggttaactcggaggaaggtggggatgacgtcaaatcatcatgccccttatgtccagggcttcacacatgctacaatggtcggtacaatgcgcgtgcgagcctgtgagggtgagcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcatgggagctgtcgaaggtgggatcggcgattgggacgaagtcgtaacaaggtagccgtaccggaaggtgcggctggatcacctcctttctaaggag

SEQ ID NO: 2981 - DNA, 1525 bp, Corynebacterium genitalium
  ref <308>: DATABASE ACCESSION NUMBER: NCBI ACCESSION: NZ_RBLQ01000019.1
  ref <309>: DATABASE ENTRY DATE: 2019-04-01
  ref <313>: RELEVANT RESIDUES IN SEQ ID NO: (1)..(1525)
tttgtggagagtttgatcctggctcaggatgaacgctggcggcgtgcttaacacatgcaagtcgaacggaaaggccagtgcttgcactggtactcgagtggcgaacgggtgagtaacacgtgggtgatctgccctgcacttcgggataagcctgggaaactgggtctaataccggataggaccacattttggatggtgtggtggaaagtttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagcgtatttgtgacggtacctggagaagaagcaccggctaactacgtgccagcagccgcggtaatacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgccgtagagatacggtttccctttgtggttggtgtacaggtggtgcatggttgtcgtcagctcgtgtcgtgagatgttgggttaagtcccgcaacgagcgcaacccttgtcttatgttgccagcaattcggttggggactcgtgagagactgccggggttaactcggaggaaggtggggatgacgtcaaatcatcatgccccttatgtccagggcttcacacatgctacaatggtcggtacaacgcgtttgcgagcctgtgagggtgtgctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgttaaagggagctgtcgaaggtgggatcggcgattgggacgaagtcgtaacaaggtagccgtaccggaaggtgcggctggatcacctcctttctaaggag

SEQ ID NO: 2982 - DNA, 1532 bp, Corynebacterium geronticis
  ref <308>: DATABASE ACCESSION NUMBER: NCBI ACCESSION: NZ_CP033897.1
  ref <309>: DATABASE ENTRY DATE: 2019-04-01
  ref <313>: RELEVANT RESIDUES IN SEQ ID NO: (1)..(1532)
tttgtggagagtttgatcctggctcaggacgaacgctggcggcgtgcttaacacatgcaagtcgaacggaaaggccttgcttgcaaggtactcgagtggcgaacgggtgagtaacacgtgggtgacctgccctgcactttgggataagcctgggaaactgggtctaataccagataggaccatgatgtagtgattgtggtggaaagttttttcggtgtgggatgggcccgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaacctctttcgcaagggacgaagcgttttgtgacggtaccttgagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtaggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttcccttgtggttggtgtacaggtggtgcatggttgtcgtcagctcgtgtcgtgagatgttgggttaagtcccgcaacgagcgcaacccttgtcttatgttgccagcacgtgatggtggggactcatgagagactgccggggtgaactcggaggaaggtggggatgacgtcaaatcatcatgccccttatgtccagggcttcacacatgctacaatggtcggtacaacgcgcagcgaacctgtgagggtgagcgaatcgctgaaagccggactcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaccaccgtgtgtggggggagtggtcgaaggtgggatcggcgattgggacgaagtcgtaacaaggtagccgtaccggaaggtgcggctggatcacctcctttctaaggag

SEQ ID NO: 2983 - DNA, 1527 bp, Corynebacterium glaucum
  ref <308>: DATABASE ACCESSION NUMBER: NCBI ACCESSION: NZ_CP019688.1
  ref <309>: DATABASE ENTRY DATE: 2019-04-01
  ref <313>: RELEVANT RESIDUES IN SEQ ID NO: (1)..(1527)
ggtgtttttgtggagagtttgatcctggctcaggatgaacgctggcggcgtgcttaacacatgcaagtcgaacggaaaggccgaagcttgctttggtactcgagtggcgaacgggtgagtaacacgtgggtgatctgccctgcactttgggataagcctgggaaactgggtctaataccggataggaccacggtgtggtgatcgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccaaagacgaattttgacggtatttggagaagaagcaccggctaactacgtgccagcagccgcggtaatacgtagggtgcgagcgttgtccggaattactgggcgtaaagagctcgtaggtggtttgtcgcgtcgtttgtggaataccggggcttaacttcggggttgcatacgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgccgcagagatgtggtttcccttgtggttggtgtacaggtggtgcatggttgtcgtcagctcgtgtcgtgagatgttgggttaagtcccgcaacgagcgcaacccttgtcttatgttgccagcatgttgtggtggggactcatgagagactgccggggttaactcggaggaaggtggggatgacgtcaaatcatcatgccccttatgtccagggcttcacacatgctacaatggtcggtacaacgcgcttgcgagcctgtgagggtgagcgaatcgctctaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcaaaaggagctgtcgaaggtgggatcggcgattgggacgaagtcgtaacaaggtagccgtaccggaaggtgcggctggatcacctcctttctaaggag

SEQ ID NO: 2984 - DNA, 1525 bp, Corynebacterium gottingense
  ref <308>: DATABASE ACCESSION NUMBER: NCBI ACCESSION: NZ_RDRE01000102.1
  ref <309>: DATABASE ENTRY DATE: 2019-04-01
  ref <313>: RELEVANT RESIDUES IN SEQ ID NO: (1)..(1525)
tttgtggagagtttgatcctggctcaggatgaacgctggcggcgtgcttaacacatgcaagtcgaacggaaaggccctgcttgcagggtactcgagtggcgaacgggtgagtaacacgtgggtgatctgccctgtactttgggataagcctgggaaactgggtctaataccgaatatgaccacttcttggatggggtggtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaaccgacgaagcttttgtgacggtaggttgagaagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtgaactcggaggaaggtggggatgacgtcaaatcatcatgccccttatgtccagggcttcacacatgctacaatggtcggtacaacgcgtgtgcgatcctgtgagggtgtgctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaacttgttagggagtggtcgaaggtgggatcggcgattgggacgaagtcgtaacaaggtagccgtaccggaaggtgcggctggatcacctcctttctaaggag

SEQ ID NO: 2985 - DNA, 1525 bp, Corynebacterium hadale; identical to SEQ ID NO: 2984
  ref <308>: DATABASE ACCESSION NUMBER: NCBI ACCESSION: NZ_NSGM01000018.1
  ref <309>: DATABASE ENTRY DATE: 2019-04-01
  ref <313>: RELEVANT RESIDUES IN SEQ ID NO: (1)..(1525)

SEQ ID NO: 2986 - DNA, 1540 bp, Corynebacterium heidelbergense
  ref <308>: DATABASE ACCESSION NUMBER: NCBI ACCESSION: NZ_QHCV01000116.1
  ref <309>: DATABASE ENTRY DATE: 2019-04-01
  ref <313>: RELEVANT RESIDUES IN SEQ ID NO: (1)..(1540)
tttatggagagtttgatcctggctcaggacgaacgctggcggcgtgcttaacacatgcaagtcgaacggaaaggccgaagcttgcttcggtactcgagtggcgaacgggtgagtaacacgtgggtgatctgcctcgtacttcaggataagcctgggaaactgggtctaatactggataggaccatgttttagtgtgcatggtggaaagttttgtcggtatgagatgagcccgcggcctatcagcttgttggtggggtaatggcctaccaaggcgacgacgggtagccggcctgagagggtggacggccacattgggactgagacacggcccagactcctacgggaggcagcagtggggaatcttgcacaatgggcgcaagcctgatgcagcgacgccgcgtgggggatgacggccttcgggttgtaaacccctttcgctagggaagaagctgccctttttgtgggtggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggtgcttaacgctgggcgggcaggcgatacgggcataactggagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgctgtaaacggtgggcgctaggtgtgggggtttttcacgattcccgtgccgtagctaacgcattaagcgccccgcctggggagtacggtcgcaaggctaaaactcaaaggaattgacgggggcccgcacaagcggcggagcatgtggattaattcgatgcaacgcgaagaaccttacctgggcttgacatatgcaggatcgccgcagagatgtggtttcccttgtggtctgtatacaggtggtgcatggttgtcgtcagctcgtgtcgtgagatgttgggttaagtcccgcaacgagcgcaacccttgtcttgtgttgccagcacgtggtggtggggacttgcaagagactgccggggttaactcggaggaaggtggggatgacgtcaaatcatcatgccccttatgtccagggcttcacacatgctacaatggttggtacagtgagcagcgatcccgtgagggggagcgaatctcttaaagccagcctcagttcggattggagtctgcaactcgactccatgaagtcggagtcgctagtaatcgcagatcagcaacgctgcggtgaatacgttcccgggccttgtacacaccgcccgtcacgtcatgaaagttggtaacacccgaagccagtggcccaaactcgttagggagctgtcgaaggtgggatcggcgattgggacgaagtcgtaacaaggtagccgtaccggaaggtgcggctggatcacctcctttctaaggag

SEQ ID NO: 2987 - DNA, 1525 bp, Corynebacterium ihumii; identical to SEQ ID NO: 2981
  ref <308>: DATABASE ACCESSION NUMBER: NCBI ACCESSION: NZ_HG001324.1
  ref <309>: DATABASE ENTRY DATE: 2019-04-01
  ref <313>: RELEVANT RESIDUES IN SEQ ID NO: (1)..(1525)

SEQ ID NO: 2988 - DNA, 1530 bp, Corynebacterium imitans
  ref <308>: DATABASE ACCESSION NUMBER: NCBI ACCESSION: NZ_LT906467.1
  ref <309>: DATABASE ENTRY DATE: 2019-04-01
  ref <313>: RELEVANT RESIDUES IN SEQ ID NO: (1)..(1530)
gtttttgtggagagtttgatcctggctcaggatgaacgctggcggcgtgcttaacacatgcaagtcgaacggaaaggccgaagcttgcttcggtactcgagtggcgaacgggtgagtaacacgtgggtgatctgccctgtacttcgggataagcttgggaaactgggtctaataccggatatgacgatctcttggatggggttgtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaaccgacgaagcttttgtgacggtaggttgagaagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagcttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgtttgcgagctcgtgagggtgggctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaacttgttagggagtggtcgaaggtgggatcggcgattgggacgaagtcgtaacaaggtagccgtaccggaaggtgcggctggatcacctcctttctaaggag

SEQ ID NO: 2989 - DNA, 1536 bp, Corynebacterium jeikeium
  ref <308>: DATABASE ACCESSION NUMBER: NCBI ACCESSION: NZ_LS483459.1
  ref <309>: DATABASE ENTRY DATE: 2019-04-01
  ref <313>: RELEVANT RESIDUES IN SEQ ID NO: (1)..(1536)
tttatggagagtttgatcctggctcaggacgaacgctggcggcgtgcttaacacatgcaagtcgaacggaaaggctccttgcttgcaaggggtactcgagtggcgaacgggtgagtaacacgtgggtgatctgccttgcacttcgggataagcctgggaaactgggtctaataccggataggaccatgctttagtgtgtgtggtggaaagttttttcggtgcaagatgagcccgcggcctatcagcttgttggtggggtaatggcctaccaaggcgacgacgggtagccggcctgagagggtgtacggccacattgggactgagacacggcccagactcctacgggaggcagcagtggggaatattgcacaatgggcgcaagcctgatgcagcgacgccgcgtgggggatgacggccttcgggttgtaaactcctttcgctagggaagaagccactgtgtggtgacggtacctggataagaagcaccggctaactacgtgccagcagccgcggtaatacgtagggtgcgagcgttgtccggaattactgggcgtaaagagctcgtaggtggtttgtcgcgtcgtctgtgaaatcccggggcttaacttcgggcgtgcaggcgatacgggcataactagagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtgggggttttatttacgattcccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttgtgttgccagcacgttatggtggggactcgcgagagactgccggggttaactcggaggaaggtggggatgacgtcaaatcatcatgccccttatgtccagggcttcacacatgctacaatggtcggtacagtgggttgcgataccgtgaggtggagctaatcccttaaagccggtctcagttcggattggagtctgcaactcgactccatgaagtcggagtcgctagtaatcgcagatcagcaacgctgcggtgaatacgttcccgggccttgtacacaccgcccgtcgcgtcatgaaagttggtaacacccgaagccagtggcccaaacttgttagggagctgtcgaaggtgggattggcgattgggacgaagtcgtaacaaggtagccgtaccggaaggtgcggctggatcacctcctttctaaggag

SEQ ID NO: 2990 - DNA, 1530 bp, Corynebacterium kefirresidentii
  ref <308>: DATABASE ACCESSION NUMBER: NCBI ACCESSION: NZ_NGUZ01000036.1
  ref <309>: DATABASE ENTRY DATE: 2019-04-01
  ref <313>: RELEVANT RESIDUES IN SEQ ID NO: (1)..(1530)
tttttttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcgggtggatcacctcctttctaaggag

SEQ ID NO: 2991 - DNA, 1529 bp, Corynebacterium kroppenstedtii
  ref <308>: DATABASE ACCESSION NUMBER: NCBI ACCESSION: NZ_PNHH01000017.1
  ref <309>: DATABASE ENTRY DATE: 2019-04-01
  ref <313>: RELEVANT RESIDUES IN SEQ ID NO: (1)..(1529)
tgtatggagagtttgatcctggctcaggacgaacgctggcggcgtgcttaacacatgcaagtcgaacggaaaggccctgcttgcagggtgctcgagtggcgaacgggtgagtaacacgtgggtgatctgccccttactttgggataagcctgggaaactgggtctaatactggataggaccatgctgtaggtggtgtggtggaaagattagtttcggtaagggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcagccatgacgaagccttcgggtgacggtagtggtagaagaagcaccggctaactacgtgccagcagccgcggtaatacgtagggtgcgagcgttgtccggaattactgggcgtaaagagctcgtaggtggtctgtcgcgtcatttgtgaaagcccggggcttaactccgggttggcaggtgatacgggcatgactggagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgcactggatgcggccagagatggttgttccctttgtggctggtgtgcaggtggtgcatggttgtcgtcagctcgtgtcgtgagatgttgggttaagtcccgcaacgagcgcaacccttgtctcgtgttgccagcatttggttggggactcgcgggagactgccggggttaactcggaggaaggtggggatgacgtcaaatcatcatgccccttatgtccagggcttcacacatgctacaatggctggtacagagagttgcgataccgtgaggtggggctaatctcgtaaagccagtctcagttcggattggagtctgcaactcgactccatgaagtcggagtcgctagtaatcgcagatcagcaatgctgcggtgaatacgttcccgggccttgtacacaccgcccgtcacgtcatgaaagttggtaacacccgaagccggtggcctaaactcgttagggagccgtcgaaggtgggattggcgattgggacgaagtcgtaacaaggtagccgtaccggaaggtgcggctggatcacctcctttctaaggag

SEQ ID NO: 2992 - DNA, 1541 bp, Corynebacterium kutscheri
  ref <308>: DATABASE ACCESSION NUMBER: NCBI ACCESSION: NZ_LR134407.1
  ref <309>: DATABASE ENTRY DATE: 2019-04-01
  ref <313>: RELEVANT RESIDUES IN SEQ ID NO: (1)..(1541)
tttgtggagagtttgatcctggctcaggacgaacgctggcggcgtgcttaacacatgcaagtcgaacggaaaggctttcttgcttgcaagagagtactcgagtggcgaacgggtgagtaacacgtgggtgatctgcccctaacttcgggataagcttgggaaactgggtctaataccggataggaccacattttagtgtgtgtggtggaaagttttttcggttagggatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggattgaaggccttcgggttgtaaacctctttcgctagggacgaagcttattttgtgacggtacctagataagaagcaccggctaactacgtgccagcagccgcggtaatacgtagggtgcgagcgttgtccggatttactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagcctcttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtacaggatcgggctagagatagtttttcctttttaggtctgtatacaggtggtgcatggttgtcgtcagctcgtgtcgtgagatgttgggttaagtcccgcaacgagcgcaacccttgtcttatgttgccagcacattttggtggggactcatgagagactgccggggttaactcggaggaaggtggggatgacgtcaaatcatcatgccccttatgtccagggcttcacacatgctacaatggtcggtacaacgcgctgcgagcctgtgagggtaagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcctaaccacgtttgtggagggagtggtcgaaggtgggattggcgattgggacgaagtcgtaacaaggtagccgtaccggaaggtgcggctggatcacctcctttctaaggag

SEQ ID NO: 2993 - DNA, 1528 bp, Corynebacterium lactis
  ref <308>: DATABASE ACCESSION NUMBER: NCBI ACCESSION: NZ_ULHE01000002.1
  ref <309>: DATABASE ENTRY DATE: 2019-04-01
  ref <313>: RELEVANT RESIDUES IN SEQ ID NO: (1)..(1528)
ttttatggagggtttgatcctggctcaggacgaacgctggcggcgtgcttaacacatgcaagtcgaacggtaaggcctcagcttgctggggtacacgagtggcgaacgggtgagtaacacgtgggtgacctgccctgcacttcgggataagcctgggaaactgggtctaataccggataggaccgcactgtaggggtgtggtggaaagttttttcggtgtgggatgggcccgcggcctatcagcttgttggtggggtaatggcctaccaaggcgtcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaagggtttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatggggagcgaacaggattagataccctggtagtccatgccgtaaacggtgggcgctaggtgtgggtttccttccacgggatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatgcaggatcgggctagagatagtctttcccttgtggcttgtatacaggtggtgcatggttgtcgtcagctcgtgtcgtgagatgttgggttaagtcccgcaacgagcgcaacccttgtcttatgttgccagcacgtgatggtggggactcgtaagagactgccggggtcaactcggaggaaggtggggatgacgtcaaatcatcatgccccttatgtccagggcttcacacatgctacaatggtcggtacagtgggttgcgagcctgtgagggtgagctaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcctaactttgtgagggagctgtcgaaggtgggattggcgattgggacgaagtcgtaacaaggtagccgtaccggaaggtgcggctggatcacctcctttctaaggag

SEQ ID NO: 2994 - DNA, 1526 bp, Corynebacterium macginleyi
  ref <308>: DATABASE ACCESSION NUMBER: NCBI ACCESSION: NZ_REGD01000069.1
  ref <309>: DATABASE ENTRY DATE: 2019-04-01
  ref <313>: RELEVANT RESIDUES IN SEQ ID NO: (1)..(1526)
tttgtggagagtttgatcctggctcaggacgaacgctggcggcgtgcttaacacatgcaagtcgaacggaaaggccctgcttgcggggtactcgagtggcgaacgggtgagtaacacgtgggtgatctgccctgcacttcgggataagcttgggaaactgggtctaataccggataggaccgcactttagtgtgtgtggtggaaagttttttcggtgtaggatgagctcgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgaagcttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattctggggcttaactccgggcgtgcaggcgatacgggcataacttgagtgctgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgctgtaaacggtgggcgctaggtgtgagggtttttctacgattctcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacacgagatcgctgcagagatgtagtttcccttttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgttgcgacactgtgaggtggagcgaatcgctgaaagccggtcttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcctaaacgtgttagggagccgtcgaaggtgggattggcgattgggacgaagtcgtaacaaggtacccgtaccggaaggtgcgggtggatcacctcctttctaaggag

SEQ ID NO: 2995 - DNA, 1536 bp, Corynebacterium mastitidis
  ref <308>: DATABASE ACCESSION NUMBER: NCBI ACCESSION: NZ_PJAF01000055.1
  ref <309>: DATABASE ENTRY DATE: 2019-04-01
  ref <313>: RELEVANT RESIDUES IN SEQ ID NO: (1)..(1536)
tttgtggagagtttgatcctggctcaggacgaacgctggcggcgtgcttaacacatgcaagtcgaacggaaaggcctcagcttgctggggtactcgagtggcgaacgggtgagtaacacgtgggtgatctgccctcaacttcgggataagcttgggaaactgggtctaataccggataggaccatggtttagtgttcatggtggaaagctttatgtggttggggatgagctcgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctaccgacgaagccctttggggtgacggtaggtggagaagaagcaccggctaactacgtgccagcagccgcggtaatacgtagggtgcgagcgttgtccggatttactgggcgtaaagagctcgtaggtggtttgtcgcgtcgtctgtgaaattccggggcttaactccgggcgtgcaggcgatacgggcataacttgagtgctgtaggggtaactggaattcctggtgtagcggtggaatgcgcagatatcaggaggaacaccgatggcgaaggcaggttactgggcagttactgacgctgaggagcgaaagcatgggtagcgaacaggattagataccctggtagtccatgctgtaaacggtgggcgctaggtgtgagcctcttccacggggtttgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcggcgcagagatgcgttttccctttgtggttggtgtacaggtggtgcatggttgtcgtcagctcgtgtcgtgagatgttgggttaagtcccgcaacgagcgcaacccttgtcttatgttgccagcacgtggtggtggggactcatgagagactgccggggttaactcggaggaaggtggggatgacgtcaaatcatcatgccccttatgtccagggcttcacacatgctacaatggtcggtacagtaggttgcgataccgtgaggtggagctaatccttgtaaagtcggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaaaaccatggcctaacccttgtggagggagtggttgaaggtgggattggcgattgggacgaagtcgtaacaaggtagccgtaccggaaggtgcggctggatcacctcctttctatggag

SEQ ID NO: 2996 - DNA, 1559 bp, Corynebacterium matruchotii
  ref <308>: DATABASE ACCESSION NUMBER: NCBI ACCESSION: NZ_LR134504.1
  ref <309>: DATABASE ENTRY DATE: 2019-04-01
  ref <313>: RELEVANT RESIDUES IN SEQ ID NO: (1)..(1559)
ttttttggagagtttgatcctggctcaggacgaacgctggcggcgtgcttaacacatgcaagtcgaacggaaaggccctcaccttggtgggggtgctcgagtggcgaacgggtgagtaacacgtgggtgatctgccctgtacttcgggataagcttgggaaactgggtctaataccggataggaccatggtttagtgtctcatggtggaaaaattattgttttggtgcaggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgttagggacgaagccgcacctttttttgggtgtggtgacggtacctttgttaagaagcaccggctaactacgtgccagcagccgcggtaatacgtagggtgcgagcgttgtccggaattactgggcgtaaagagctcgtaggtggtttgttgcgtcgtctgtgaaattccggggcttaacttcggggtggcaggcgatacgggcataactagagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgctgtaaacggtgggcgttaggtgtggggaccggtttggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatgcaccagacggttgtagagatacgtacctccctttgtggttggtgtgcaggtggtgcatggttgtcgtcagctcgtgtcgtgagatgttgggttaagtcccgcaacgagcgcaacccttgtcttatgttgccagcactttgggtggggactcatgagagactgccggggttaactcggaggaaggtggggatgacgtcaaatcatcatgccctttatgcccagggcttcacacatgctacaatggttagtacaacgcgctgcgagcctgtgagggtgagcgaatcgctgaaagctaatctcagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagcccatggcctaaccaccgtttggtggggggagtggtcgaaggtgggattggcgattgggacgaagtcgtaacaaggtagccgtaccggaaggtgcggctggatcacctcctttctaaggag

SEQ ID NO: 2997 - DNA, 1526 bp, Corynebacterium minutissimum
  ref <308>: DATABASE ACCESSION NUMBER: NCBI ACCESSION: NZ_LS483460.1
  ref <309>: DATABASE ENTRY DATE: 2019-04-01
  ref <313>: RELEVANT RESIDUES IN SEQ ID NO: (1)..(1526)
tttgtggagagtttgatcctggctcaggacgaacgctggcggcgtgcttaacacatgcaagtcgaacggaaaggccagtgcttgcactggtactcgagtggcgaacgggtgagtaacacgtgggtgatctgccttgcactctgggataagcttgggaaactgggtctaataccggataggaaccgtctttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttcccttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggtcttagttcggattggggtctgcaactcgaccccatgaagtcggagtcgctagtaatcgtagatcagcaatgctgcggtgaatacgttcccgggccttgtacacaccgcccgtcacgtcatgaaagttggtaacacccgaagccagtggctcaaacttgttagggagctgtctaaggtgggatcggcgattgggacgaagtcgtaacaaggtacccgtaccggaaggtgcgggtggatcacctcctttctaaggag

SEQ ID NO: 2998 - DNA, 1558 bp, Corynebacterium otitidis
  ref <308>: DATABASE ACCESSION NUMBER: NCBI ACCESSION: NZ_LBNF01000094.1
  ref <309>: DATABASE ENTRY DATE: 2019-04-01
  ref <313>: RELEVANT RESIDUES IN SEQ ID NO: (1)..(1558)
ttgatggagagtttgatcctggctcaggacgaacgctggcggcgtgcttaacacatgcaagtcgaacggaaaggcctgctttcccttgtggattgcgggtactcgagtggcgaacgggtgagtaacacgtgagtgatctgcccccaacttgggtataagcctgggaaactgggtctaattcccgataggactgcagggtggtgcctgtggtggaaaacgattttctagtggttggggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcggaagcctgatgcagcgacgccgcgtgggggatgacggccttcgggttgtaaactcctttcgaccgcgaggaagccgcctggttggaagggtggtgacggtagtggtagaagaagcaccggctaactacgtgccagcagccgcggtaatacgtagggtgcgagcgttgtccggatttactgggcgtaaagagctcgtaggtggcttgtcgcgtcgtctgtgaaagtctggggcttaactccgggtgtgcaggcgatacgggctggcttgagtgctgtaggggagactggaattcctggtgtagcggtggaatgcgcagatatcaggaggaacaccgatggcgaaggcaggtctctgggcagtcactgacgctgaggagcgagagcatgggtagcgaacaggattagataccctggtagtccatgctgtaaacggtgggcgctaggtgtggggactttccatggtttccgtgtcgtagctaacgcgttaagcgccccgcctggggagtacggccgcaaggctaaaactcaaaggaattgacgggggcccgcacaagcggcggagcatgtggattaattcgatgcaacgcgaagaaccttacctgggtttgacatgcactagatgaggcgagagatcgtctgtccctttgtggctggtgtgcaggtggtgcatggttgtcgtcagctcgtgtcgtgagatgttgggttaagtcccgcaacgagcgtaacccttgtcttatgttgccagcacgttgtggtggggactcgtgagagactgccggggtgaactcggaggaaggtggggatgacgtcaaatcatcatgccccttatgtccagggcttcacacatgctacaatggccggtacagtaggttgcgagaccgtgaggtggagctaatcctttaaagctggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccgccgtctccacccttgtggtggtgtggtgtcgaaggtgggatcggcgattgggacgaagtcgtaacaaggtagccgtaccggaaggtgcggctggatcacctcctttctaaggag

SEQ ID NO: 2999 - DNA, 1534 bp, Corynebacterium pelargi
  ref <308>: DATABASE ACCESSION NUMBER: NCBI ACCESSION: NZ_CP035299.1
  ref <309>: DATABASE ENTRY DATE: 2019-04-01
  ref <313>: RELEVANT RESIDUES IN SEQ ID NO: (1)..(1534)
tttgtggagagtttgatcctggctcaggacgaacgctggcggcgtgcttaacacatgcaagtcgaacggaaaggcctctgcttgcaggggtactcgagtggcgaacgggtgagtaacacgtgggtgacctgccctgcactttgggataagcctgggaaactgggtctaataccagataggaccacatggtagttcgtgtggtggaaagttttttcggtgtgggatgggcccgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaacctctttcgcaagggacgaagctttttgtgacggtaccttgagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtagggatcttccacgatttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgggctagagatagtctttcccttgtggttggtgtacaggtggtgcatggttgtcgtcagctcgtgtcgtgagatgttgggttaagtcccgcaacgagcgcaacccttgtcttatgttgccagcacgtagtggtggggactcatgagagactgccggggtgaactcggaggaaggtggggatgacgtcaaatcatcatgccccttatgtccagggcttcacacatgctacaatggtcggtacaacgcgcagcgagcctgtgagggtaagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaccactgtgtgtggagggagtggtcgaaggtgggatcggcgattgggacgaagtcgtaacaaggtagccgtaccggaaggtgcggctggatcacctcctttctaaggag

SEQ ID NO: 3000 - DNA, 1517 bp, Corynebacterium pilosum
  ref <308>: DATABASE ACCESSION NUMBER: NCBI ACCESSION: NZ_UFXQ01000001.1
  ref <309>: DATABASE ENTRY DATE: 2019-04-01
  ref <313>: RELEVANT RESIDUES IN SEQ ID NO: (1)..(1517)
tttgtggagagtttgatcctggctcaggatgaacgctggcggcgtgcttaacacatgcaagtcgaacggaaaggccctgcttgcagggtactcgagtggcgaacgggtgagtaacacgtgggttatctgccctgtacttcgggataagcttgggaaactgggtctaataccggatattcaactttgtgttggaaagcctttgggcggtatgggatgagcttgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgctagggacgaagcttttgtgacggtacctagataagaagcaccggctaactacgtgccagcagccgcggtaatacgtagggtgcaagcgttgtccggaattactgggcgtaaagagctcgtaggtggtttgtcgcgtcgtctgtggaagtccggggcttaacttcgggagtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgctgtaaacggtgggcgctaggtgtaggggacttccacgttttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttcccttgtggctggtgtacaggtggtgcatggttgtcgtcagctcgtgtcgtgagatgttgggttaagtcccgcaacgagcgcaacccttgtcttatgttgccagcacgttgtggtggggactcatgagagactgccggggttaactcggaggaaggtggggatgacgtcaaatcatcatgccccttatgtccagggcttcacacatgctacaatggttggtacagcgcgcagcgagatcgtgaggttgagctaatcgcacaaagccagccgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtagccgtaccggaaggtgcggctggatcacctcctttctaaggag

SEQ ID NO: 3001 - DNA, 1525 bp, Corynebacterium propinquum
  ref <308>: DATABASE ACCESSION NUMBER: NCBI ACCESSION: NZ_RBMD01000026.1
  ref <309>: DATABASE ENTRY DATE: 2019-04-01
  ref <313>: RELEVANT RESIDUES IN SEQ ID NO: (1)..(1525)
ttttatggagagtttgatcctggctcaggacgaacgctggcggcgtgcttaacacatgcaagtcgaacggaaaggccttttcggaggtactcgagtggcgaacgggtgagtaacacgtgggtgatctgccctgcactctgggataagcctgggaaactgggtctaataccggataggaccgcactttagtgtgtgtggtggaaagttttttcggtgtaggatgagcccgcggcctatcagcttgttggtggggtaatggcctaccaaggcggcgacgggtagccggactgagaggttggtcggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttttgtgacggtacctggagaagaagcaccggctaactacgtgccagcagccgcggtaatacgtagggtgcaagcgttgtccggaattactgggcgtaaagagctcgtaggtggtttgtcacgtcgtctgtgaaattccacagcttaactgtgggcgtgcaggcgatacgggctgacttgagtactgtaggggtaactggaattcctggtgtagcggtgaaatgcgcagatatcaggaggaacaccgatggcgaaggcaggttactgggcagttactgacgctgaggagcgaaagcatgggtagcaaacaggattagataccctggtagtccatgccgtaaacggtgggcgctaggtgtaggggccttttggggtttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttcccttgtggctggtgtacaggtggtgcatggctgtcgtcagctcgtgtcgtgagatgttgggttaagtcccgcaacgagcgcaacccttgtcttatgttgccagcacgttatggtggggactcatgagagactgccggggttaactcggaggaaggtggggacgacgtcaagtcatcatgccccttatgtccagggcttcacacatgctacaatggccggtacaatgcgcagcgagcctgtgagggtgagctaatcgcttaaagctggtcttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggctcaaactcgtttagggagccgtcgaaggtgggatcggcgattgggacgaagtcgtaacaaggtagccgtaccggaaggtgcggctggatcacctcctttctaaggag

SEQ ID NO: 3002 - DNA, 1538 bp, Corynebacterium pseudodiphtheriticum
  ref <308>: DATABASE ACCESSION NUMBER: NCBI ACCESSION: NZ_RBLP01000013.1
  ref <309>: DATABASE ENTRY DATE: 2019-04-01
  ref <313>: RELEVANT RESIDUES IN SEQ ID NO: (1)..(1538)
gaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggcagttgcctaatacgtaactgttttgacgttaccgacagaataagcaccggctaactctgtgccagcagccgcggtaatacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaagccttgagcttttagtggcgcagctaacgcattaagttgaccgcctggggagtacggccgcaaggctaaaactcaaaggaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgcaacgagcgcaacccttgtccttagttaccagcacgttatggtgggcactctaaggagactgccggtgacaaaccggaggaaggtggggatgacgtcaagtcatcatggcccttacggcctgggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggagcctgcggctggatcacctccttaa

SEQ ID NO: 3003 - DNA, 1533 bp, Corynebacterium pseudopelargi
  ref <308>: DATABASE ACCESSION NUMBER: NCBI ACCESSION: NZ_CP033898.1
  ref <309>: DATABASE ENTRY DATE: 2019-04-01
  ref <313>: RELEVANT RESIDUES IN SEQ ID NO: (1)..(1533)
tttgtggagagtttgatcctggctcaggacgaacgctggcggcgtgcttaacacatgcaagtcgaacggaaaggccctgcttgcagggtgctcgagtggcgaacgggtgagtaacacgtgggtgacctgccctgcactttgggataagcctgggaaactgggtctaataccagataggaccacatggtagttcgtgtggtggaaagttttttcggtgtgggatgggcccgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaacctctttcgcaagggacgaagcttttttgtgacggtaccttgagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtagggatcttccacgatttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgggctagagatagtctttcccttgtggttggtgtacaggtggtgcatggttgtcgtcagctcgtgtcgtgagatgttgggttaagtcccgcaacgagcgcaacccttgtcttatgttgccagcacgtaatggtggggactcatgagagactgccggggtgaactcggaggaaggtggggatgacgtcaaatcatcatgccccttatgtccagggcttcacacatgctacaatggtcggtacaacgcgcagcgagcctgtgagggtaagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaccactgtgtgtggagggagtggtcgaaggtgggatcggcgattgggacgaagtcgtaacaaggtagccgtaccggaaggtgcggctggatcacctcctttctaaggag

SEQ ID NO: 3004 - DNA, 1528 bp, Corynebacterium pseudotuberculosis
  ref <308>: DATABASE ACCESSION NUMBER: NCBI ACCESSION: NZ_CP035719.1
  ref <309>: DATABASE ENTRY DATE: 2019-04-01
  ref <313>: RELEVANT RESIDUES IN SEQ ID NO: (1)..(1528)
tttgtggagagtttgatcctggctcaggacgaacgctggcggcgtgcttaacacatgcaagtcgaacggaaaggccccttcgggggtgctcgagtggcgaacgggtgagtaacacgtgggtgatctgcctcgtactctgggataagcctgggaaactgggtctaatactggataggaccgcactttagtgtgtgtggtggaaagttttttcggtacgagatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggccttcgggttgtaaacctctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagggtcttccacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaagatcggcgtagagatacgttttcccttgtggtttgtatacaggtggtgcatggttgtcgtcagctcgtgtcgtgagatgttgggttaagtcccgcaacgagcgcaacccttgtcttatgttgccagcacgtgatggtggggactcatgagagactgccggggttaactcggaggaaggtggggatgacgtcaaatcatcatgccccttatgtccagggcttcacacatgctacaatggtcggtacaacgcgttgcgagcctgtgagggtgagcgaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaccagtttctggggggagtggtcgaaggtgggatcggcgattgggacgaagtcgtaacaaggtagccgtaccggaaggtgcggctggatcacctcctttctaaggag

SEQ ID NO: 3005 - DNA, 1536 bp, Corynebacterium pyruviciproducens
  ref <308>: DATABASE ACCESSION NUMBER: NCBI ACCESSION: NZ_PKHO01000001.1
  ref <309>: DATABASE ENTRY DATE: 2019-04-01
  ref <313>: RELEVANT RESIDUES IN SEQ ID NO: (1)..(1536)
tttgttggagagtttgatcctggctcaggatgaacgctggcggcgtgcttaacacatgcaagtcgaacggaaaggcctcagcttgctggggtgctcgagtggcgaacgggtgagtaacacgtaggtgatctgcctttcacttcgggataagcttgggaaactgggtctaataccggatattcacggcaccgtggttggtgtggtggaaagcttttgcggtgggagatgagcttgcggcctatcagcttgttggtggggtaatggcctaccaaggcggcgacgggtagccggcctgagagggtgtgcggccacattgggactgagatacggcccagactcctacgggaggcagcagtggggaattttgcacaatgggcggaagcctgatgcagcgacgccgtgtgggggatgaaggccttcgggttgtaaactcctttcgtcagggacgaagtttgtttgacggtacctggataagaagcaccggctaactacgtgccagcagccgcggtaatacgtagggtgcgagcgttgtccggatttactgggcgtaaagggctcgtaggtggtgtgttgcgtcgtctgtgtaatccaggggcttaacttttggttggcaggcgatacgggcattgcttgagtgctgtaggggagactggaattcctggtgtagcggtgaaatgcgcagatatcaggaggaacaccgatggcgaaggcaggtctctgggcagttactgacgctgaggagcgagagcatgggtagcgaacaggattagataccctggtagtctatgctgtaaacggtgggcgctaggtgtgagcctcttccacggggtttgtgccgtagctaacgctttaagcgccccgcctggggagtacggccgcaaggctaaaactcaaaggaattgacgggggcccgcacaagcggcggagcatgtggattaattcgatgcaacgcgaagaaccttacctgggcttgacataggcaggatgggcgcagagatgtgtcgtccctttgtggtctgtttacaggtggtgcatggttgtcgtcagctcgtgtcgtgagatgttgggttaagtcccgcaacgagcgcaacccttgtcttatgttgccagcacgttgtggtggggactcgtgagagactgccggggttaactcggaggaaggtggggatgacgtcaaatcatcatgccccttatgtccagggcttcacacatgctacaatggttggtacagtgcgtgagcaacaccgtgaggtggagctaatcgctaaagccagtctcagttcggattggggtctgcaactcgacctcatgaagtcggagtcgctagtaatcgcagatcagcagtgctgcggtgaatacgttcccgggccttgtacacaccgcccgtcacgtcatgaaagttggtaacacccgaagcccatggcctaaccggttttgccggggggagtggtcgaaggtgggattggcgattgggacgaagtcgtaacaaggtagccgtaccggaaggtgcggctggatcacctcctttctaaggag

SEQ ID NO: 3006 - DNA, 1534 bp, Corynebacterium renale
  ref <308>: DATABASE ACCESSION NUMBER: NCBI ACCESSION: NZ_LS483464.1
  ref <309>: DATABASE ENTRY DATE: 2019-04-01
  ref <313>: RELEVANT RESIDUES IN SEQ ID NO: (1)..(1534)
tttgtggagagtttgatcctggctcaggacgaacgctggcggcgtgcttaacacatgcaagtcgaacggaaaggccactgcttgcagtggtactcgagtggcgaacgggtgagtaacacgtgggtgatctgccctgtactttgggataagcctgggaaactgggtctaataccggataggaccatcgtttagtgtcggtggtggaaagcttttgcggtacgggatgagctcgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgagggatgacggccttcgggttgtaaacctctttcgctagggacgaagcttttgtgacggtacctagagaagaagcaccggctaactacgtgccagcagccgcggtaatacgtagggtgcgagcgttgtccggatttactgggcgtaaagagctcgtaggtggtttgtcgcgtcgtctgtgaaattccggggcttaactccgggcgtgcaggcgatacgggcataacttgagtactgtaggggagactggaattcctggtgtagcggtggaatgcgcagatatcaggaggaacaccgatggcgaaggcaggtctctgggcagttactgacactgaggagcgaaagcatgggtagcgaacaggattagataccctggtagtccatgccgtaaacggtgggcgctaggtgtgagacccttccacgggttttgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatacaccagaccgggccagagatggtctttccctttgtggttggtgtacaggtggtgcatggttgtcgtcagctcgtgtcgtgagatgttgggttaagtcccgtaacgagcgcaacccttgtcttatgttgccagcacgttgtggtggggactcatgagagactgccggggttaactcggaggaaggtggggatgacgtcaaatcatcatgccccttatgtccagggcttcacacatgctacaatggtcggtacaacgcgtgtgctacttcgtgaggagatgctaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaccagttttctggggggagtggtcgaaggtgggatcggcgattgggacgaagtcgtaacaaggtagccgtaccggaaggtgcggctggatcacctcctttctatggag

SEQ ID NO: 3007 - DNA, 1519 bp, Corynebacterium riegelii
  ref <308>: DATABASE ACCESSION NUMBER: NCBI ACCESSION: NZ_PKHN01000002.1
  ref <309>: DATABASE ENTRY DATE: 2019-04-01
  ref <313>: RELEVANT RESIDUES IN SEQ ID NO: (1)..(1519)
tttgtggagagtttgatcctggctcaggatgaacgctggcggcgtgcttaacacatgcaagtcgaacggaaaggcccaagcttgcttgggtactcgagtggcgaacgggtgagtaacacgtgggtgatctgccctgcacttcgggataagcctgggaaactgggtctaataccggataggaccacttcgtagttgttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgccaaagacgaattttgacggtatttggagaagaagcaccggctaactacgtgccagcagccgcggtaatacgtagggtgcgagcgttgtccggaattactgggcgtaaagagctcgtaggtggtttgtcgcgtcgtttgtggaagtccacggcttaactgtgggactgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttatgttgccagcacgtgatggtggggacttatgagaaactgccggggttaactcggaggaaggtggggatgacgtcaaatcatcatgccccttatgtccagggcttcacacatgctacaatggtcggtacaacgcgcagctacctcgtgaggggacgcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtcaaaaggagctgtcgaaggtgggatcggcgattgggacgaagtcgtaacaaggtagccgtaccggaaggtgcggctggatcacctcctttctaaggag

SEQ ID NO: 3008 - DNA, 1527 bp, Corynebacterium segmentosum
  ref <308>: DATABASE ACCESSION NUMBER: NCBI ACCESSION: NZ_LR134408.1
  ref <309>: DATABASE ENTRY DATE: 2019-04-01
  ref <313>: RELEVANT RESIDUES IN SEQ ID NO: (1)..(1527)
tttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcttgggaaactgggtctaataccggataggaaccatctttagtgtggtggttggaaagttttttcggtgtaggatgagctcgcggcctatcagcttgttggtggggtaatggcctaccaaggcggcgacgggtagccggcctgagagggtgtacggccacattgggactgagatacggcccagactcctacgggaggcagcagtggggaatattgcacaatgggcgcaagcctgatgcagcgacgccgcgtgggggatgaaggccttcgggttgtaaactcctttcgctagggacgaagctttgttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattctggggcttaactccgggcgtgcaggcgatacgggcataacttgagtgctgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtctttctacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagattgggctagagatagttcgtccctttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgctgcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcctaaacgtgttagggagccgtcgaaggtgggatcggcgattgggacgaagtcgtaacaaggtacccgtaccggaaggtgcgggtggatcacctcctttctaaggag

SEQ ID NO: 3009 - DNA, 1540 bp, Corynebacterium sp. 13CS0277
  ref <308>: DATABASE ACCESSION NUMBER: NCBI ACCESSION: NZ_PPDL01000045.1
  ref <309>: DATABASE ENTRY DATE: 2019-04-01
  ref <313>: RELEVANT RESIDUES IN SEQ ID NO: (1)..(1540)
tttgtggagagtttgatcctggctcaggacgaacgctggcggcgtgcttaacacatgcaagtcgaacggaaaggcctcagcttgctggggtactcgagtggcgaacgggtgagtaacacgtgggtgatctaccctgaactctgggataagcctgggaaactgggtctaataccggataggaccgtgctttagtgtgcatggtggaaagttttttcggttcaggatgagcccgcggcctatcagcttgttggtggggtaatggcctaccaaggcgtcgacgggtagccggcctgagagggtgtacggccacattgggactgagacacggcccagactcctacgggaggcagcagtggggaatattgcacaatgggcgcaagcctgatgcagcgacgccgcgtgagggatgacggccttcgggttgtaaacctctttcgcgagggacgaagctaccgtttttcggtggtgactgtaccttgataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtgctgtaggggagactggaactcctggtgtagcggtgaaatgcgcagatatcaggaagaacaccaatggcgaaggcaggtctctgggcagtaactgacgctgaggagcgaaagcatgggtagcgaacaggattagataccctggtagtccatgccgtaaacggtgggcgctaggtgtaggggacttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaggatcgctgcagagatgtagtttcccttgtggcttgtatacaggtggtgcatggttgtcgtcagctcgtgtcgtgagatgttgggttaagtcccgcaacgagcgcaacccttgtcttatgttgccagcacgtgatggtggggactcatgagagactgccggggtcaactcggaggaaggtggggatgacgtcaaatcatcatgccccttatgtccagggcttcacacatgctacaatggtcggtacaacgcgtcgcgagcctgtgagggtgagctaatcgctgaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaacccttgtggggggagctgtcgaaggtgggatcggcgattgggacgaagtcgtaacaaggtagccgtaccggaaggtgcggctggatcacctcctttctaaggag

SEQ ID NO: 3010 - DNA, 1521 bp, Corynebacterium sp. BCW 4722
  ref <308>: DATABASE ACCESSION NUMBER: NCBI ACCESSION: NZ_MKAX01000944.1
  ref <309>: DATABASE ENTRY DATE: 2019-04-01
  ref <313>: RELEVANT RESIDUES IN SEQ ID NO: (1)..(1521)
tttgtggagagtttgatcctggctcaggatgaacgctggcggcgtgcttaacacatgcaagtcgaacggaaaggccctagcttgctggggtgctcgagtggcgaacgggtgagtaacacgtgggtgatctgccctgcacttcgggataagcctgggaaactgggtctaataccggataggaccacttcttggaggttgtggtggaaagtttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccaaggacgaagctttttgtgacggtacttggagaagaagcaccggctaactacgtgccagcagccgcggtaatacgtagggtgcgagcgttgtccggaattactgggcgtaaagagctcgtaggtggtttgtcgcgtcgtttgtgtaagtccgtagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagatcgctgcagagatgtagtttccctttgtggctggtgtacaggtggtgcatggttgtcgtcagctcgtgtcgtgagatgttgggttaagtcccgcaacgagcgcaacccttgtcttgtgttgccagcatttggttggggactcatgagagactgccggggttaactcggaggaaggtggggatgacgtcaaatcatcatgccccttatgtccagggcttcacacatgctacaatggtcggtacaacgcgcggcgagcctgtgagggtgagcgaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctgtaatgggagctgtcgaaggtgggatcggcgattgggacgaagtcgtaacaaggtagccgtaccggaaggtgcggctggatcacctcctttctaaggag

SEQ ID NO: 3011 - DNA, 1531 bp, Corynebacterium sp. CCUG 69366
  ref <308>: DATABASE ACCESSION NUMBER: NCBI ACCESSION: NZ_PTJO01000009.1
  ref <309>: DATABASE ENTRY DATE: 2019-04-01
  ref <313>: RELEVANT RESIDUES IN SEQ ID NO: (1)..(1531)
tttgtggagagtttgatcctggctcaggacgaacgctggcggcgtgcttaacacatgcaagtcgaacggaaaggcccagcttgctgggtactcgagtggcgaacgggtgagtaacacgtgggtgatctgccttgcacttcgggataagcctgggaaactgggtctaataccggatatgaccttcctttagtgtggaaggtggaaagatttatcggtgcgagatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaacctctttcgacagggacgaagtgaaaatgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggagcttaactccgggcgtgcaggcgatacgggcaatacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggacttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatataccagatcggcgtagagatacgtcttcccttgtggttggtatacaggtggtgcatggttgtcgtcagctcgtgtcgtgagatgttgggttaagtcccgcaacgagcgcaacccttgtcttatgttgccagcacgttatggtgggaactcatgagaaactgccggggtcaactcggaggaaggtggggatgacgtcaaatcatcatgccccttatgtccagggcttcacacatgctacaatggtcggtacagcaggttgcgagacggtgacgtcaagctaatccttcaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaacacccttgtggtgggggagctgtcgaaggtgggatcggcgattgggacgaagtcgtaacaaggtagccgtaccggaaggtgcggctggatcacctcctttctaaggag

SEQ ID NO: 3012 - DNA, 570 bp, Corynebacterium sp. HMSC034H07
  ref <308>: DATABASE ACCESSION NUMBER: NCBI ACCESSION: NZ_KV819484.1
  ref <309>: DATABASE ENTRY DATE: 2019-04-01
  ref <313>: RELEVANT RESIDUES IN SEQ ID NO: (1)..(570)
gtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactagattgctgcagagatgtagtgtcccttgtggctggtgtacagg

SEQ ID NO: 3013 - DNA, 1440 bp, Corynebacterium sp. HMSC059E07
  ref <308>: DATABASE ACCESSION NUMBER: NCBI ACCESSION: NZ_KV816301.1
  ref <309>: DATABASE ENTRY DATE: 2019-04-01
  ref <313>: RELEVANT RESIDUES IN SEQ ID NO: (1)..(1440)
ggggtactcgagtggcgaacgggtgagtaacacgtgggtgatctgccttgcactctgggataagcttgggaaactgggtctaataccggatatgaactgcctttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagattgctgcagagatgtagtgtcccttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggtcttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtacccgtaccggaaggtgcgggtggatcacctcctttctaaggag

SEQ ID NO: 3014 - DNA, 1440 bp, Corynebacterium sp. HMSC062E11; identical to SEQ ID NO: 3013
  ref <308>: DATABASE ACCESSION NUMBER: NCBI ACCESSION: NZ_KV806777.1
  ref <309>: DATABASE ENTRY DATE: 2019-04-01
  ref <313>: RELEVANT RESIDUES IN SEQ ID NO: (1)..(1440)

SEQ ID NO: 3015 - DNA, 1438 bp, Corynebacterium sp. HMSC068H04
  ref <308>: DATABASE ACCESSION NUMBER: NCBI ACCESSION: NZ_KV803961.1
  ref <309>: DATABASE ENTRY DATE: 2019-04-01
  ref <313>: RELEVANT RESIDUES IN SEQ ID NO: (1)..(1438)
ggtactcgagtggcgaacgggtgagtaacacgtgggtgatctgccttgcactctgggataagcttgggaaactgggtctaataccggatatgaactgcctttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagctttttgtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccagattgctgcagagatgtagtgtcccttgtggttggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggtcttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtacccgtaccggaaggtgcgggtggatcacctcctttctaaggag

SEQ ID NO: 3016 - DNA, 1071 bp, Corynebacterium sp. HMSC074A09
  ref <308>: DATABASE ACCESSION NUMBER: NCBI ACCESSION: NZ_KV805141.1
  ref <309>: DATABASE ENTRY DATE: 2019-04-01
  ref <313>: RELEVANT RESIDUES IN SEQ ID NO: (1)..(1071)
gtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactagattgctgcagagatgtagtgtcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtacccgtaccggaaggtgcgggtggatcacctcctttctaaggag

SEQ ID NO: 3017 - DNA, 1024 bp, Corynebacterium sp. HMSC076G08
  ref <308>: DATABASE ACCESSION NUMBER: NCBI ACCESSION: NZ_KV805060.1
  ref <309>: DATABASE ENTRY DATE: 2019-04-01
  ref <313>: RELEVANT RESIDUES IN SEQ ID NO: (1)..(1024)
tttgtggagagtttgatcctggctcaggacgaacgctggcggcgtgcttaacacatgcaagtcgaacggaaaggccagtgcttgcactggtactcgagtggcgaacgggtgagtaacacgtgggtgatctgccttgcactctgggataagcttgggaaactgggtctaataccggatatgagccgcttttagtgtggtggttggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgacggccttcgggttgtaaactcctttcgacagggacgaagcgcaagtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagttactgacgctgaggagcgaaagcatgggtagcaaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactagattgctgcagagatgtagtgtcccttgtggctggtgtacagg

SEQ ID NO: 3018 - DNA, 1534 bp, Corynebacterium sp. JB4
  ref <308>: DATABASE ACCESSION NUMBER: NCBI ACCESSION: NZ_FWFE01000021.1
  ref <309>: DATABASE ENTRY DATE: 2019-04-01
  ref <313>: RELEVANT RESIDUES IN SEQ ID NO: (1)..(1534)
ttttttgtggagagtttgatcctggctcaggatgaacgctggcggcgtgcttaacacatgcaagtcgaacggaaaggcctcagcttgctggggtactcgagtggcgaacgggtgagtaacacgtgggtgatctgccctgcactttgggataagcttgggaaactgggtctaataccgaatatgaccacttcttggatgttgtggtggaaagcttttgcggtgtgggatgagcctgcggcctatcagcttgttggtggggtaatggcctaccaaggcggcgacgggtatccggcctgagagggtgtacggacacattgggactgagatacggcccagactcctacgggaggcagcagtggggaatattgcacaatgggcgcaagcctgatgcagcgacgccgcgtgggggatgaaggccttcgggttgtaaactcctttcgctatcgacgaagccacttgtggtgacggtaggtagataagaagcaccggctaactacgtgccagcagccgcggtaatacgtagggtgcaagcgttgtccggaattactgggcgtaaagagctcgtaggtggtttgtcgcgtcgtctgtgaaatcccggggcttaacttcgggcgtgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatgtaccggattgggctagagatagtctttcccttgtggtcggtatacaggtggtgcatggttgtcgtcagctcgtgtcgtgagatgttgggttaagtcccgcaacgagcgcaacccttgtcttatgttgccagcacgttatggtgggaactcatgagagactgccggggttaactcggaggaaggtggggatgacgtcaaatcatcatgccccttatgtccagggcttcacacatgctacaatggtcgatacaatgggcagcgacatcgtgaggtgaagcgaatccctgaaagtcggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacttgttagggagctgtcgaaggtgggatcggcgattgggacgaagtcgtaacaaggtagccgtaccggaaggtgcggctggatcacctcctttctaaggag

SEQ ID NO: 3019 - DNA, 1527 bp, Corynebacterium sp. Marseille-P4329
  ref <308>: DATABASE ACCESSION NUMBER: NCBI ACCESSION: NZ_LS990887.1
  ref <309>: DATABASE ENTRY DATE: 2019-04-01
  ref <313>: RELEVANT RESIDUES IN SEQ ID NO: (1)..(1527)
tttgtggagagtttgatcctggctcaggatgaacgctggcggcgtgcttaacacatgcaagtcgaacggaaaggccctgcttgcagggtactcgagtggcgaacgggtgagtaacacgtgggtgatctgccctgtacttcgggataagcttgggaaactgggtctaataccggataggactgcatcgtgggtggtgtggtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgtaagtgacggtacctggataagaagcaccggctaactacgtgccagcagccgcggtaatacgtagggtgcgagcgttgtccggaattactgggcgtaaagagctcgtaggtggtttgtcgcgtcgtttgtgtaagtccacggcttaactgtgggactgcaggcgatacgggcataacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggaccgggccagagatggtctttccctttgtggctggtgtacaggtggtgcatggttgtcgtcagctcgtgtcgtgagatgttgggttaagtcccgcaacgagcgcaacccttgtcttatgttgccagcacgttgtggtggggactcatgagagactgccggggttaactcggaggaaggtggggatgacgtcaaatcatcatgccccttatgtccagggcttcacacatgctacaatggtcggtacagcgcgtgcgcgagttcgtgaggatgagctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggctcaaactcgttagagagctgtcgaaggtgggatcggcgattgggacgaagtcgtaacaaggtagccgtaccggaaggtgcggctggatcacctcctttctaaggag

SEQ ID NO: 3020 - DNA, 1527 bp, Corynebacterium sp. NML 120412
  ref <308>: DATABASE ACCESSION NUMBER: NCBI ACCESSION: NZ_NSGL01000001.1
  ref <309>: DATABASE ENTRY DATE: 2019-04-01
  ref <313>: RELEVANT RESIDUES IN SEQ ID NO: (1)..(1527)
tttttgtggagagtttgatcctggctcaggatgaacgctggcggcgtgcttaacacatgcaagtcgaacggaaaggccctgcttgcagggtactcgagtggcgaacgggtgagtaacacgtgggtgatctgccctgtactttgggataagcctgggaaactgggtctaataccgaatatgaccacttcttggatggggtggtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaaccgacgaagcttttgtgacggtaggttgagaagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtgaactcggaggaaggtggggatgacgtcaaatcatcatgccccttatgtccagggcttcacacatgctacaatggtcggtacaacgcgtgtgcgatcctgtgagggtgtgctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaacttgttagggagtggtcgaaggtgggatcggcgattgggacgaagtcgtaacaaggtagccgtaccggaaggtgcggctggatcacctcctttctaaggag

SEQ ID NO: 3021 - DNA, 1528 bp, Corynebacterium sp. NML 150383
  ref <308>: DATABASE ACCESSION NUMBER: NCBI ACCESSION: NZ_NSGK01000019.1
  ref <309>: DATABASE ENTRY DATE: 2019-04-01
  ref <313>: RELEVANT RESIDUES IN SEQ ID NO: (1)..(1528)
ttttttgtggagagtttgatcctggctcaggatgaacgctggcggcgtgcttaacacatgcaagtcgaacggaaaggccctgcttgcagggtactcgagtggcgaacgggtgagtaacacgtgggtgatctgccctgtactttgggataagcctgggaaactgggtctaataccgaatatgaccacttcttggatggggtggtggaaagcttttgcggtatgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgcaaccgacgaagcttttgtgacggtaggttgagaagaagcaccggctaactacgtgccagcagccgcggtaatacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacactggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtgaactcggaggaaggtggggatgacgtcaaatcatcatgccccttatgtccagggcttcacacatgctacaatggtcggtacaacgcgtgtgcgatcctgtgagggtgtgctaatcgctgaaagccggtcgtagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagcccatggcccaaacgtgttagggagtggtcgaaggtgggatcggcgattgggacgaagtcgtaacaaggtagccgtaccggaaggtgcggctggatcacctcctttctaaggag

SEQ ID NO: 3022 - DNA, 1527 bp, Corynebacterium sp. YIM 101343
  ref <308>: DATABASE ACCESSION NUMBER: NCBI ACCESSION: NZ_RXHJ01000043.1
  ref <309>: DATABASE ENTRY DATE: 2019-04-01
  ref <313>: RELEVANT RESIDUES IN SEQ ID NO: (1)..(1527)
tttgtggagagtttgatcctggctcaggacgaacgctggcggcgtgcttaacacatgcaagtcgaacggaaaggccccgcttgcggggtactcgagtggcgaacgggtgagtaacacgtgggtgatctgccctgcacttcgggataagcctgggaaactgggtctaataccggataggaccctcctttagtgtggggggtggaaagatttatcggtgcaggatgagcccgcggcctatcagcttgttggtggggtaatggcctaccaaggcgtcgacgggtagccggcctgagagggtggacggccacattgggactgagatacggcccagactcctacgggaggcagcagtggggaatattgcacaatgggcggaagcctgatgcagcgacgccgcgtgggggatgacggccttcgggttgtaaacccctttcgacagggacgaagcgcaagtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaacctcgggcgtgcaggcgatacgggcaatacttgagtgctgtaggggagactggaattcctggtgtagcggtgaaatgcgcagatatcaggaggaacaccaatggcgaaggcaggtctctgggcagtaactgacgctgaggagcgaaagcatgggtagcgaacaggattagataccctggtagtccatgccgtaaacggtgggcgctaggtgtaggggacttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggaccggcgtagagatacgtcttcccttgtggctggtgtacaggtggtgcatggttgtcgtcagctcgtgtcgtgagatgttgggttaagtcccgcaacgagcgcaacccttgtcttatgttgccagcacgtgatggtggggactcatgagagactgccggggtcaactcggaggaaggtggggatgacgtcaaatcatcatgccccttatgtccagggcttcacacatgctacaatggtcggtacagcaggtcgcgaactcgtgagggtgagctaatcctacaaagccggcctcagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcccaacccttgtggagggagctgtcgaaggtgggatcggcgattgggacgaagtcgtaacaaggtagccgtaccggaaggtgcggctggatcacctcctttctaaggag

SEQ ID NO: 3023 - DNA, 1526 bp, Corynebacterium striatum
  ref <308>: DATABASE ACCESSION NUMBER: NCBI ACCESSION: NZ_UFXV01000002.1
  ref <309>: DATABASE ENTRY DATE: 2019-04-01
  ref <313>: RELEVANT RESIDUES IN SEQ ID NO: (1)..(1526)
tttgtggagagtttgatcctggctcaggacgaacgctggcggcgtgcttaacacatgcaagtcgaacggaaaggcctgcagcttgctgcgggtactcgagtggcgaacgggtgagtaacacgtgggtgatctgccttgcacttcgggataagcttgggaaactgggtctaataccggataggacagctgtttagtgtcagttgtggaaagttttttcggtgcaagatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcggaagcctgatgcagcgacgccgcgtgggggatgaaggccttcgggttgtaaactcctttcgacagggacgaagcgtaagtgacggtacctgtataagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggctgacttgagtgctgtaggggagactggaattcctggtgtagcggtgaaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtagggggcttccacgtcttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacaagacaggcgtagagatacgtcctcccttgtggtttgtatacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggctcaaactcgttagggagctgtcgaaggtgggatcggcgattgggacgaagtcgtaacaaggtagccgtaccggaaggtgcggctggatcacctcctttctaaggag

SEQ ID NO: 3024 - DNA, 1526 bp, Corynebacterium tuberculostearicum
  ref <308>: DATABASE ACCESSION NUMBER: NCBI ACCESSION: NZ_ACVP01000009.1
  ref <309>: DATABASE ENTRY DATE: 2019-04-01
  ref <313>: RELEVANT RESIDUES IN SEQ ID NO: (1)..(1526)
tttgtggagagtttgatcctggctcaggacgaacgctggcggcgtgcttaacacatgcaagtcgaacggaaaggccctgcttgcagggtactcgagtggcgaacgggtgagtaacacgtgggtgatctgccctgcacttcgggataagcctgggaaactgggtctaataccggataggagccatttttagtgtgatggttggaaagttttttcggtgtaggatgagctcgcggcctatcagcttgttggtggggtaatggcctaccaaggcggcgacgggtagccggcctgagagggtggacggccacattgggactgagatacggcccagactcctacgggaggcagcagtggggaatattgcacaatgggcgcaagcctgatgcagcgacgccgcgtgggggatgacggccttcgggttgtaaactcctttcgctagggacgaagctttttgtgacggtacctagataagaagcaccggctaactacgtgccagcagccgcggtaatacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacaggattagataccctggtagtccatgccgtaaacggtgggcgctaggtgtgagggtcttttcacgactttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgggctagagatagtctttccctttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggtcaactcggaggaaggtggggatgacgtcaaatcatcatgccccttatgtccagggcttcacacatgctacaatggtcggtacaacgcgcagcgacactgtgaggtggagcgaatcgctgaaagccggccttagttcggattggggtctgcaactcgaccccatgaagtcggagtcgctagtaatcgcagatcagcaatgctgcggtgaatacgttcccgggccttgtacacaccgcccgtcacgtcatgaaagttggtaacacccgaagccggtggcccaaacttgttagggagccgtcgaaggtgggatcggcgattgggacgaagtcgtaacaaggtacccgtaccggaaggtgcgggtggatcacctcctttctaaggag

SEQ ID NO: 3025 - DNA, 1526 bp, Corynebacterium tuscaniense
  ref <308>: DATABASE ACCESSION NUMBER: NCBI ACCESSION: NZ_PNHG01000030.1
  ref <309>: DATABASE ENTRY DATE: 2019-04-01
  ref <313>: RELEVANT RESIDUES IN SEQ ID NO: (1)..(1526)
tttgtggagagtttgatcctggctcaggatgaacgctggcggcgtgcttaacacatgcaagtcgaacggaaaggcccaagcttgcttgggtgctcgagtggcgaacgggtgagtaacacgtgggtgatctgccctgcacttcgggataagcctgggaaactgggtctaataccggataggaccatcgtgttgtggcggtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgccagggacgaagcgttatgtgacggtacctggataagaagcaccggctaactacgtgccagcagccgcggtaatacgtagggtgcgagcgttgtccggaattactgggcgtaaagagctcgtaggtggtttgtcgcgtcgtttgtgtaataccgcagcttaactgtggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggatcgctgcagagatgtagtttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgcagctactctgtgaggggatgcgaatcgctgaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaacgtgttagggagctgtcgaaggtgggatcggcgattgggacgaagtcgtaacaaggtagccgtaccggaaggtgcggctggatcacctcctttctaaggag

SEQ ID NO: 3026 - DNA, 1526 bp, Corynebacterium ulcerans; identical to SEQ ID NO: 2997
  ref <308>: DATABASE ACCESSION NUMBER: NCBI ACCESSION: NZ_LR134339.1
  ref <309>: DATABASE ENTRY DATE: 2019-04-01
  ref <313>: RELEVANT RESIDUES IN SEQ ID NO: (1)..(1526)

SEQ ID NO: 3027 - DNA, 1437 bp, Corynebacterium urinapleomorphum
  ref <308>: DATABASE ACCESSION NUMBER: NCBI ACCESSION: NZ_LT706957.1
  ref <309>: DATABASE ENTRY DATE: 2019-04-01
  ref <313>: RELEVANT RESIDUES IN SEQ ID NO: (1)..(1437)
ggtactcgagtggcgaacgggtgagtaacacgtgggtgatctgccctgcacttcgggataagcctgggaaactgggtctaataccggataggaccacttctttgaggttgtggtggaaagttttttcggtgtgggatgagctcgcggcctatcagcttgttggtggggtaatggcctaccaaggcgtcgacgggtagccggcctgagagggtgtacggccacattgggactgagatacggcccagactcctacgggaggcagcagtggggaatattgcacaatgggcgcaagcctgatgcagcgacgccgcgtgggggatgacggccttcgggttgtaaactcctttcgtcagggacgaagcgaaagtgacggtacctggataagaagcaccggctaactacgtgccagcagccgcggtaatacgtagggtgcgagcgttgtccggaattactgggcgtaaagagctcgtaggtggtttgtcgcgtcgtttgtggaataccgcagcttaactgtggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacaggattagataccctggtagtccatgccgtaaacggtgggcgctaggtgtgagtcccttccacggggttcgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatacaccggaccgggccagagatggtctttcccttgtggctggtgtacaggtggtgcatggttgtcgtcagctcgtgtcgtgagatgttgggttaagtcccgcaacgagcgcaacccttgtcttatgttgccagcatttggttggggactcatgagagactgccggggttaactcggaggaaggtggggatgacgtcaaatcatcatgccccttatgtccagggcttcacacatgctacaatggtcggtacaacgcgttgctacttcgtgaggagatgctaatcgctaaaagccggccttagttcggattggggtctgcaactcgaccccatgaagtcggagtcgctagtaatcgcagatcagcaacgctgcggtgaatacgttcccgggccttgtacacaccgcccgtcacgtcatgaaagttggtaacacccgaagccagtggcctaaactcgttagggagctgtcgaaggtgggatcggcgattgggacgaagtcgtaacaaggtagccgtaccggaaggtgcggctggatcacctcctttctaaggag

SEQ ID NO: 3028 - DNA, 1527 bp, Corynebacterium xerosis
  ref <308>: DATABASE ACCESSION NUMBER: NCBI ACCESSION: NZ_CP032788.1
  ref <309>: DATABASE ENTRY DATE: 2019-04-01
  ref <313>: RELEVANT RESIDUES IN SEQ ID NO: (1)..(1527)
tttgtggagagtttgatcctggctcaggacgaacgctggcggcgtgcttaacacatgcaagtcgaacggtaaggccccagcttgctggggtacacgagtggcgaacgggtgagtaacacgtgggtgacctgccccgcacttcgggataagcctgggaaactgggtctaataccggataggaccgcaccgtgagggtgtggtggaaagtttttcggtgtgggatgggcccgcggcctatcagcttgttggtggggtaatggcctaccaaggcggcgacgggtagccggcctgagagggtggacggccacattgggactgagacacggcccagactcctacgggaggcagcagtggggaatattgcacaatgggcggaagcctgatgcagcgacgccgcgtgggggatgacggccttcgggttgtaaactcctttcaccatcgacgaaggttttctgacggtagatggagaagaagcaccggctaactacgtgccagcagccgcggtaatacgtagggtgcgagcgttgtccggaattactgggcgtaaagagctcgtaggtggtttgtcgcgtcgtctgtgaaattccggggcttaactccgggcgtgcaggcgatacgggcataacttgagtactgtaggggagactggaattcctggtgtagcggtgaaatgcgcagatatcaggaggaacaccggtggcgaaggcgggtctctgggcagtaactgacgctgaggagcgaaagcatgggtagcgaacaggattagataccctggtagtccatgccgtaaacggtgggcgctaggtgtaggggtcttccacgacttctgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggcttgacatatacgggaccgggccagagatggtccttcccttgtggctcgtatacaggtggtgcatggttgtcgtcagctcgtgtcgtgagatgttgggttaagtcccgcaacgagcgcaacccttgtcttatgttgccagcacgtaatggtggggactcgtgagaaactgccggggtcaactcggaggaaggtggggatgacgtcaaatcatcatgccccttatgtccagggcttcacacatgctacaatggtcggtacagtgggttgcgatgccgtgaggtggagctaatccctgaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccagtggcccaacccttgtggggggagctgtcgaaggtgggatcggcgattgggacgaagtcgtaacaaggtagccgtaccggaaggtgcggctggatcacctcctttctaaggag

SEQ ID NO: 3029 - DNA, 1530 bp, Couchioplanes caeruleus
  ref <308>: DATABASE ACCESSION NUMBER: NCBI ACCESSION: NZ_RJKL01000001.1
  ref <309>: DATABASE ENTRY DATE: 2019-04-01
  ref <313>: RELEVANT RESIDUES IN SEQ ID NO: (1)..(1530)
tgttggagagtttgatcctggctcaggacgaacgctggcggcgtgcttaacacatgcaagtcgagcggaaaggccctttcgggggtactcgagcggcgaacgggtgagtaacacgtgagcaacctgccctggactttgggataaccctcggaaacgggggctaataccggatacgacacgccttcgcatggggtgcgtgtggaaagttttttcggtctgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgcggctcaaccgcgggcctgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtgggggacctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcactcgaaaactcgcagagatgcggggtccttcggggcgggtgacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaaagggttgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcctaaccccttgtgggagggagccgtcgaaggtggggctggcgattgggacgaagtcgtaacaaggtagccgtaccggaaggtgcggctggatcacctcctttctaaggagca

SEQ ID NO: 3030 - DNA, 1543 bp, Coxiella burnetii
  ref <308>: DATABASE ACCESSION NUMBER: NCBI ACCESSION: NZ_CP035112.1
  ref <309>: DATABASE ENTRY DATE: 2019-04-01
  ref <313>: RELEVANT RESIDUES IN SEQ ID NO: (1)..(1543)
taattgaagagtttgattctggctcagattgaacgctagcggcatgcttaacacatgcaagtcgaacggcagcgcggggagcttgctccctggcggcgagtggcggacgggtgagtaatgcgtaggaatctaccttgtagtgggggataacctggggaaactcgggctaataccgcataatctctttggagcaaagcgggggatcttcggacctcgtgctataagatgagcctacgtcggattagcttgttggtggggtaatggcctaccaaggcgacgatccgtagctggtctgagaggacgatcagccacactgggactgagacacggcccagactcctacgggaggcagcagtggggaatattggacaatgggggaaaccctgatccagcaatgccgcgtgtgtgaagaaggccttcgggttgtaaagcactttcggtggggaagaaattctcaagggtaatatccttgggcgttgacgttacccacagaagaagcactggctaactctgtgccagcagccgcggtaatacagagagtgcaagcgttaatcggaatcactgggcgtaaagcgcgcgtaggtggatatttaagtcggatgtgaaagccctgggcttaacctgggaattgcacccgatactgggtatcttgagtatggtagagggaagtggaatttccggtgtagcggtgaaatgcgtagatatcggaaagaacaccagtggcgaaggcgacttcctggaccaatactgacactgaggcgcgaaagcgtggggagcaaacaggattagagaccctggtagtccacgccgtcaacgatgagaactagctgttgggaagttcacttcttagtagcgaagctaacgcgttaagttctccgcctggggagtacggccgcaaggttaaaactcaaagaaattgacgggggcccgcacaagcggtggagcatgtggtttaattcgatgcaacgcgaaaaaccttacctacccttgacatcctcggaacttgtcagagatgatttggtgccttcgggaaccgagtgacaggtgctgcatggctgtcgtcagctcgtgtcgtgagatgttgggttaagtcccgtaacgagcgcaaccctcgtccttagttgccagcgagtcaagtcgggaactctaaggagactgccggtgataaaccggaggaaggtggggatgatgtcaagtcatcatggcccttacgggtagggctacacacgtgctacaatgggcagtacaaagggttgccaagccgcgaggtggagctaatcccagaaaactgctcgtagtccggattggagtctgcaactcgactccatgaagttggaatcgctagtaatcgcgaatcagcatgtcgcggtgaatacgttctcgggccttgtacacaccgcccgtcacaccatgggagtgaattgtaccagaagcgggtaggctaaccttcgggaggccgctcaccacggtatgatccatgactggggtgaagtcgtaacaaggtagccgtaggggaacctgcggctggatcacctccttactt

SEQ ID NO: 3031 - DNA, 290 bp, Coxiella endosymbiont of Rhipicephalus microplus
  ref <308>: DATABASE ACCESSION NUMBER: NCBI ACCESSION: NZ_DLUJ01000036.1
  ref <309>: DATABASE ENTRY DATE: 2019-04-01
  ref <313>: RELEVANT RESIDUES IN SEQ ID NO: (1)..(290)
gttgctacatcgcgaggtaaagctaatcccaaaaaactgttcgtagtccggattggagtctgcaactcgactccatgaagttggaatcgctagtaatcgcgaatcagaatgtcgcggtgaatacgttctcgggccttgtacacaccgcccgtcacaccatggaagtgaattgtaccagaagcgggtaagctaaccttcgggaagctgctcaccacggtatgattcatgactggggtgaagtcgtaacaaggtagccgtaggggaacctgcggctggatcacctccttaac

SEQ ID NO: 3032 - DNA, 1544 bp, Crenobacter sp. K1W11S-77
  ref <308>: DATABASE ACCESSION NUMBER: NCBI ACCESSION: NZ_CP031337.1
  ref <309>: DATABASE ENTRY DATE: 2019-04-01
  ref <313>: RELEVANT RESIDUES IN SEQ ID NO: (1)..(1544)
ttgaactgaagagtttgatcctggctcagattgaacgctggcggcatgctttacacatgcaagtcgaacggtagcaggtccttcgggatgctgacgagtggcgaacgggtgagtaatgcgtcggaacgtaccgagtaatgggggataacgcttcgaaaggagtgctaataccgcatacgccctgagggggaaagtgggggaccggcaacggcctcacgttattcgagcggccgacgtctgattagctagttggtggggtaagagcccaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtcggggaggaaatccgcacacctaatacgtgtgtgggatgacagtacctgaagaataagcaccggctaactacgtgccagcagccgcggtaatacgtagggtgcaagcgttaatcggaattactgggcgtaaagcgtgcgcaggcggttgtgtaagtctgatgtgaaagccccgggctcaacctgggaacggcattggagactgcacggctagagtgcgtcagaggggggtggaattccgcgtgtagcagtgaaatgcgtagagatgcggaggaacaccgatggcgaaggcagccccctgggatgacactgacgctcatgcacgaaagcgtggggagcaaacaggattagataccctggtagtccacgccctaaacgatgtcgactagttgttgggggttgaaatccctggtaacgcagctaacgcgtgaagtcgaccgcctggggagtacggccgcaaggttaaaactcaaaggaattgacgggggcccgcacaagcggtggatgatgtggattaattcgatgcaacgcgaagaaccttacctagccttgacatgctcggaaccctgctgaaaggtgggggtgcccgcaagggagccgggacacaggtgctgcatggctgtcgtcagctcgtgtcgtgagatgttgggttaagtcccgcaacgagcgcaacccttgtcgttaattgccatcattcagttgggcactttaacgagactgccggtgacaaaccggaggaaggtggggatgacgtcaagtcctcatggcccttatggctagggcttcacacgtcatacaatggtcggtacagagggtcgccaagccgcgaggtggagccaatctcataaagccgatcgtagtccggattgcaggctgcaactcgcctgcatgaagtcggaatcgctagtaatcgcaggtcagcatactgcggtgaatacgttcccgggccttgtacacaccgcccgtcacaccatgggagtgggggataccagaagtgggtaggctaaccttcgggaggccgcttaccacggtatgcttcatgactggggtgaagtcgtaacaaggtagccgtaggggaacctgcggctggatcacctcctttctag

SEQ ID NO: 3033 - DNA, 1561 bp, Criblamydia sequanensis
  ref <308>: DATABASE ACCESSION NUMBER: NCBI ACCESSION: NZ_CCEJ010000017.1
  ref <309>: DATABASE ENTRY DATE: 2019-04-01
  ref <313>: RELEVANT RESIDUES IN SEQ ID NO: (1)..(1561)
ttttctttgagaatttgatcttggttcagattgaacgctggcagcgtggatgaggcatgcaagtcgaacgaagtatttgggtaactagatacttagtggcgaaagggttagtaatacatggataacctgcctctaacttgggaataacggttggaaacggccgctaataccgaatgtgatgagagaaggcatcttcttttcattaaagtgggggacttttagcctcgcggttagagaagggtccatgggatatcagctagttggtagggtaacggcctaccaaggctaagacgtctaggcggattgagagattgaccgccaacactgggactgagacactgcccagactcctacgggaggctgcagtcgagaatctttcgcaatgggcgaaagcctgacgaagcgacgctgcgtgagtgatgaaggccctcgggtcgtaaagctctttcgcctgggaacaagggaatccggctaatatccggaagacttgagagtatcaggtaaagaagcaccggctaactccgtgccagcagctgcggtaatacggagggtgcaagcgttaatcggaattattgggcgtaaagggtgcgcaggcggaaacacaagtcgggtgtgaaatcccggggctcaacctcggaacggcactcgaaactgtgtttctagaggatagaaggagaaaatggaattccacaagtagcggtgaaatgcgtagatatgtggaagaacaccggtggcgaaggcggttttctattttattcctgacgctcatgcacgaaagttaggggatcaaacaggattagataccctggtagtcctaactgtaaacgatgtgtacttggtgtagctggtctcaaccccagctgtgccgtagccaacgcgttaagtacaccgcctggggagtacagccgcaaggctgaaactcaaaagaattgacggggacccgcacaagcagtggagcatgtggtttaattcgatgcaacgcgaagaaccttacctaggcttgacatatagtggaccgcttcagaaatgaagtttttcgtatgaaccgctatacaggtgctgcatggctgtcgtcagctcgtgccgtgaggtgttgggttaagtcccgcaacgagcgcaacccttgtcattagttgccagcacgtaatggtgggaactctaatgagactgcctgggttaaccaggaggaaggtgaggatgacgtcaagtcagcatggcccttatgcctagggctacacacgtgctacaatggccggtacagagggcagcgaagccgcgaggtgaagcaaatcccataaagccggccccagttcagattgtagtctgcaactcgactacatgaagttggaattgctagtaatggcgtatcagctacgacgccgtgaatacgttcccgggtcttgtacacaccgcccgtcacatcatgggagttggttttacccgatgtcactgacttaaccgcaaggggagaagtgcctaaggtgaggccgatgactgggatgaagtcgtaacaaggtagccctaccggaaggtggggctggatcacctcctttaaggacag

SEQ ID NO: 3034 - DNA, 1492 bp, Crinalium epipsammum
  ref <308>: DATABASE ACCESSION NUMBER: NCBI ACCESSION: NC_019753.1
  ref <309>: DATABASE ENTRY DATE: 2019-04-01
  ref <313>: RELEVANT RESIDUES IN SEQ ID NO: (1)..(1492)
aaaatggagagtttgatcctggctcaggatgaacgctggcggtctgcttaacacatgcaagtcgaacggatgtagcaatacattagtggcggacgggtgagtaacgcgtgagaatctggctttaggttcgggacaaccactggaaacggtggctaataccggatgtgccgaaaggtaaaaggtttaccgcctgaagatgagctcgcgtctgattagctagttggtgtggtaagagcgcaccaaggcgacgatcagtagctggtctgagaggatgatcagccacactgggactgagacacggcccagactcctacgggaggcagcagtggggaattttccgcaatgggcgaaagcctgacggagcaagaccgcgtgagggaggaaggctcttgggtcgtaaacctcttttctctgggaataagaaagtgaaggtaccagaggaatcagcatcggctaactccgtgccagcagccgcggtaatacggaggatgcaagcgttatccggaatgattgggcgtaaagagtccgtaggtggtgattcaagtcgattgttaaagagcggggcttaaccccgtagaagcagtggaaactgaattactagagagaggtaggggtagagggaattcccggtgtagcggtgaaatgcgtagagatcgggaagaacaccagtggcgaaagcgctctactggacctcatctgacactgagggacgaaagctaggggagcgaaagggattagatacccctgtagtcctagccgtaaacgatggatactaggtgttgtctgtatcgacccggacagtgccgtagctaacgcgttaagtatcccgcctggggagtacgcacgcaagtgtgaaactcaaaggaattgacgggggcccgcacaagcggtggagtatgtggtttaattcgatgcaacgcgaacaaccttaccagggcttgacatgtctggaatcttcgtgaaagcgaggagtgccttcgggaaccagaacacaggtggtgcatggctgtcgtcagctcgtgtcgtgagatgttgggttaagtcccgcaacgagcgcaaccctcgtcctaagttgccagcattaagttgggcactctgaggagactgccggtgacaaaccggaggaaggtggggatgacgtcaagtcagcatgccccttacgtcctgggctacacacgtactacaatgctacggacaaagggcagccaaccagcgatggtgagcaaatcccataaaccgtggctcagttcagattgcaggctgcaactcgcctgcatgaaggtggaatcgctagtaatcgccggtcagcatacggcggtgaattcgttcccgggccttgtacacaccgcccgtcacaccatgggagctggtcatgcccgaagtcgttaccctaacctgtaaaggagggggatgccgaaggcagggctggtgactggggtgaagtcgtaacaaggtagccgtaccggaaggtgtggctggatcacctcctttt

SEQ ID NO: 3035 - DNA, 1497 bp, Croceicoccus mobilis
  ref <308>: DATABASE ACCESSION NUMBER: NCBI ACCESSION: NZ_LYWZ01000019.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgaaggcttcggccttagtggcgcacgggtgcgtaacgcgtgggaatctacccttaggttcggaataactcagagaaatttgagctaataccggataatgtcttcggaccaaagatttatcgcctttggatgagcccgcgttagattaggtagttggtgaggtaagagctcaccaagccgacgatctatagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcgcgtaggcggcttgccaagtcaggggtgaaatcccggggctcaaccccggaactgcccttgaaactagcaggctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgttcgggttcacagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggcggtgacagtgggcagcgaactcgcaagggtgagctaatctccaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 3036 - DNA, 1498 bp, Croceicoccus naphthovorans
  ref <308>: DATABASE ACCESSION NUMBER: NCBI ACCESSION: NZ_CP011770.1
  ref <309>: DATABASE ENTRY DATE: 2019-04-01
  ref <313>: RELEVANT RESIDUES IN SEQ ID NO: (1)..(1498)
tcaaacttgagagtttgatcctggctcagaacgaacgctggcggcatgcctaacacatgcaagtcgaacgaagccttcgggcttagtggcgcacgggtgcgtaacgcgtgggaatctacccttaggttcggaataactcagagaaatttgagctaataccggatgatgtcttcggaccaaagatttatcgcctttggatgagcccgcgtaagattagctagttggtagggtaaaggcctaccaaggcgacgatctttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggcgaaccaagtcaggggtgaaatcccggggctcaaccccggaactgcccttgaaactagtttgctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggttagaggagactctttccttcagttcggctggaccagtgacaggtgctgcatggctgtcgtcagctcgtgtcgtgagatgttgggttaagtcccgcaacgagcgcaaccctcatccttagttgctaccatttagttgggcactctaaggaaactgccggtgataagccggaggaaggtggggatgacgtcaagtcctcatggcccttacaggctgggctacacacgtgctacaatggcatctacagtgggcagctatcacgcgagtgtgagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctacgctaacccgcaagggaggtaggcgaccacggtgggatcagcgactggggtgaagtcgtaacaaggtagccgtaggggaacctgcggctggatcacctcctttctaagga

SEQ ID NO: 3037 - DNA, 1497 bp, Croceicoccus pelagius
  ref <308>: DATABASE ACCESSION NUMBER: NCBI ACCESSION: NZ_LYWY01000033.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgaaggcttcggccttagtggcgcacgggtgcgtaacgcgtgggaatctacccttaggttcggaataactcagagaaatttgagctaataccggatgatgtcttcggaccaaagatttatcgcctttggatgagcccgcgtaagattagctagttggtagggtaaaggcctaccaaggcgacgatctttagctggtctgagaggatgatcagccacactgggactgagacacggcccagactcctacgggaggcagcagtggggaatattggacaatgggcgcaagcctgatccagcaatgccgcgtgagtgatgaaggccttcgggtcgtaaagctcttttaccagggatgataatgacagtacctggagaataagctccggctaactccgtgccagcagccgcggtaatacggagggagctagcgttgttcggaattactgggcgtaaagcgcgcgtaggcggtctaccaagtcaggggtgaaatcccggggctcaaccccggaactgcccttgaaactattagactagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccggtcgcgattaccagagatggttttcttcagttcggctggaccggtgacaggtgctgcatggctgtcgtcagctcgtgtcgtgagatgttgggttaagtcccgcaacgagcgcaaccctcatccttagttgctaccatttagttgggcactctaaggaaactgccggtgataagccggaggaaggtggggatgacgtcaagtcctcatggcccttacaggctgggctacacacgtgctacaatggcatctacagtgggcagctatcacgcgagtgtgagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 3038 - DNA, 1495 bp, Croceicoccus sp. GM-16
  ref <308>: DATABASE ACCESSION NUMBER: NCBI ACCESSION: NZ_RXOL01000014.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaagtcttcggacttagtggcgcacgggtgcgtaacgcgtgggaatctacccttaggttcggaataactcagagaaatttgagctaataccggataatgtcttcggaccaaagatttatcgcctttggatgagcccgcgtaagattagctagttggtagggtaaaagcctaccaaggcgacgatctttagctggtctgagaggatgatcagccacactgggactgagacacggcccagactcctacgggaggcagcagtggggaatattggacaatgggcgcaagcctgatccagcaatgccgcgtgagtgatgaaggccttagggtcgtaaagctcttttaccagggatgataatgacagtacctggagaataagctccggctaactccgtgccagcagccgcggtaatacggagggagctagcgttgttcggaattactgggcgtaaagcgcgcgtaggcggcgaaccaagtcaggggtgaaatcccggggctcaaccccggaactgcctttgaaactagtttgctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcgtttgacatcccgatcgcgattaccagagatggttttcttcagttcggctggatcggtgacaggtgctgcatggctgtcgtcagctcgtgtcgtgagatgttgggttaagtcccgcaacgagcgcaaccctcgtccttagttgctaccatttagttgagcactctaaggaaactgccggtgataagccggaggaaggtggggatgacgtcaagtcctcatggcccttacacgctgggctacacacgtgctacaatggcggtgacagtgagcagctaactcgcgagagtatgctaatctctaaaaaccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaag

SEQ ID NO: 3039 - DNA, 1497 bp, Croceicoccus sp. H4
  ref <308>: DATABASE ACCESSION NUMBER: NCBI ACCESSION: NZ_LRSE01000037.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgaagccttcgggcttagtggcgcacgggtgcgtaacgcgtgggaatctacccttaggttcggaataactcagagaaatttgagctaataccggatgatgtcttcggaccaaagatttatcgcctttggatgagcccgcgtaagattagctagttggtagggtaaaggcctaccaaggcgacgatctttagctggtctgagaggatgatcagccacactgggactgagacacggcccagactcctacgggaggcagcagtggggaatattggacaatgggcgcaagcctgatccagcaatgccgcgtgagtgatgaaggccctcgggtcgtaaagctcttttaccagggatgataatgacagtacctggagaataagctccggctaactccgtgccagcagccgcggtaatacggagggagctagcgttgttcggaattactgggcgtaaagcgcgcgtaggcggcgaaccaagtcaggggtgaaatcccggggctcaaccccggaactgcctttgaaactagtttgctagaatcttggagaggtcagtggaattccgagtgtagaggtgaaattcgtagatattcggaagaacaccagtggcgaaggcgactgactggacaagtattgacgctgaggtgcgaaagcgtggggagcaaacaggattagataccctggtagtccacgccgtaaacgatgataactagctgtccgggcacatggtgcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcccggtcgcggttaccagagatggtttccttcagttcggctggaccggtgacaggtgctgcatggctgtcgtcagctcgtgtcgtgagatgttgggttaagtcccgcaacgagcgcaaccctcatccttagttgctaccatttagttgggcactctaaggaaactgccggtgataagccggaggaaggtggggatgacgtcaagtcctcatggcccttacaggctgggctacacacgtgctacaatggcatctacagtgggcagctatcacgcgagtgtgagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccacggtgggcttagcgactggggtgaagtcgtaacaaggtagccgtaggggaacctgcggctggatcacctcctttctaagga

SEQ ID NO: 3040 - DNA, 1449 bp, Crocinitomix catalasitica
  ref <308>: DATABASE ACCESSION NUMBER: NCBI ACCESSION: NZ_JHXV01000061.1
  ref <309>: DATABASE ENTRY DATE: 2019-04-01
  ref <313>: RELEVANT RESIDUES IN SEQ ID NO: (1)..(1449)
gcttgcttccgctgacgaccggcgcacgggtgcgtaacgcgtatagaatctaccttatactggaggatagcccgaagaaattcggattaatactccataacattcagatactgcatagtatttgacttaaagcttcggcggtataagatgactatgcgtcccattagctagttggtaaggtaacggcttaccaaggcaacgatgggtagggggcctgagagggttatcccccacactggtactgagacacggaccagactcctacgggaggcagcagtgaggaatattggacaatggaggcaactctgatccagccatgccgcgtgaaggaagaatgtcctacggattgtaaacttcttttatttgggaagaaacctttctacgtgtagaaagctgacggtaccaaacgaataaggaccggctaactccgtgccagcagccgcggtaatacggagggtccaagcgttatccggaatcattgggtttaaagggttcgcaggcggtttaataagtcagtggtgaaatcctacagctcaactgtagaatggccattgatactgttagacttgaattaagttggagtaggcggaatgtgtagtgtagcggtgaaatgcttagatattacacagaacaccgatagcgaaggcagcttactaaacttatattgacgctcatgaacgaaagcgtggggagcgaacaggattagataccctggtagtccacgccgtaaactatcattactcgatattggcgatatacggtcagtgtctaagcgaaagtgataagtaatgcacctggggagtacggtcgcaagattgaaactcaaaggaattgacgggggcccgcacaagcggtggagcatgtggtttaattcgatgatacgcgaggaaccttaccagggcttaaatgtagattgacagatttggaaacaagtccttcttcggacaatttacaaggtgctgcatggctgtcgtcagctcgtgccgtgaggtgttgggttaagtcccgcaacgagcgcaacccctattcttagttaccagcacgttaaggtggggactctaagaaaactgccggtgcaaaccgtgaggaaggtggggacgacgtcaagtcatcacggcccttacgtcctgggctacacacgtgctacaatggcgagtacagagggcagctactgggtgaccagatgctaatctcaaaaactcgtctcagttcggatcgaagtctgcaactcgacttcgtgaagctggaatcgctagtaatcgcgcatcagccatggcgcggtgaatacgttcccgggccttgtacacaccgcccgtcaaaccatggaagctgggggtgcctgaagtctgtgaccgcaaggagcggcctagggtaaaactagtaactggggttaagtcgtaacaaggtagccgtaccggaaggtgcggctggaacacctcctttctagag

SEQ ID NO: 3041 - DNA, 1532 bp, Crocinitomix sp. SM1701
  ref <308>: DATABASE ACCESSION NUMBER: NCBI ACCESSION: NZ_QKSB01000028.1
  ref <309>: DATABASE ENTRY DATE: 2019-04-01
  ref <313>: RELEVANT RESIDUES IN SEQ ID NO: (1)..(1532)
tttatacaacggagagtttgatcctggctcaggatgaacgctagcggcaggcttaacacatgcaagtcgaggggtaacagggaagcttgcttctgctgacgaccggcgcacgggtgcgtaacgcgtatacaatctaccttatactggagaatagccctaagaaattgggattaatgctccatagtattatatcttcgcatgttgatataattaaagctccggcggtataagatgagtatgcgtgatattagttagttggtaaggtaacggcttaccaagacatcgatatctagggggtctgagaggactatcccccacactggtactgagacacggaccagactcctacgggaggcagcagtgaggaatattggtcaatggaggaaactctgaaccagccatgccgcgtgaaggacgactgccctatgggttgtaaacttcttttatttgggaagaaacctttctacgtgtagaaagctgacggtaccaaatgaataaggaccggctaactccgtgccagcagccgcggtaatacggagggtccaagcgttatccggaatcattgggtttaaagggttcgcaggcggtcaattaagtcagtggtgaaatctcggggctcaactccgaaactgccattgatactgattgacttgaattaagttggagtaggcggaatgtgtagtgtagcggtgaaatgcttagatattacacagaacaccgatagcgaaggcagcttactaaacttatattgacgctcatgaacgaaagcgtggggagcgaacaggattagataccctggtagtccacgccgtaaacgatggttactcgatattggcgatatacggtcagtgtctaagcgaaagtgataagtaacccacctggggagtacggtcgcaagattgaaactcaaaggaattgacgggggcccgcacaagcggtggagcatgtggtttaattcgatgatacgcgaggaaccttaccagggcttaaatgcattatgacaggcttggaaacaagtttttcttcggacattttgcaaggtgctgcatggctgtcgtcagctcgtgccgtgaggtgttgggttaagtcccgcaacgagcgcaacccctattcttagttgccagcgagtaatgtcggggactctaagaaaactgccggcgtaagccgcgaggaaggtggggacgacgtcaagtcatcacggcccttacgtcctgggccacacacgtgctacaatggtaagtacagagggcagctacctggtgacaggatgcgaatctcgaaaacttatctcagttcggattgaagtctgcaactcgacttcatgaagctggaatcgctagtaatcgcgcatcagccatggcgcggtgaatacgttcccgggccttgtacacaccgcccgtcaagccatggaagctgggggtacctaaagtcggtaaccgaaaggagctgcctagggtaaaactagtaactggggctaagtcgtaacaaggtagccgtaccggaaggtgcggctggaacacctcctttctaga

SEQ ID NO: 3042 - DNA, 1553 bp, Cronobacter condimenti
  ref <308>: DATABASE ACCESSION NUMBER: NCBI ACCESSION: NZ_RQEO01000008.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacagggagaagcttgcttctctgctgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaagggagtgagcttaatacgctcattcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgtaaaga

SEQ ID NO: 3043 - DNA, 484 bp, Cronobacter dublinensis
  ref <308>: DATABASE ACCESSION NUMBER: NCBI ACCESSION: NZ_NROQ01000031.1
  ref <309>: DATABASE ENTRY DATE: 2019-04-01
  ref <313>: RELEVANT RESIDUES IN SEQ ID NO: (1)..(484)
agcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagc

SEQ ID NO: 3044 - DNA, 1491 bp, Cronobacter malonaticus
  ref <308>: DATABASE ACCESSION NUMBER: NCBI ACCESSION: NZ_PSON01000108.1
  ref <309>: DATABASE ENTRY DATE: 2019-04-01
  ref <313>: RELEVANT RESIDUES IN SEQ ID NO: (1)..(1491)
ttaattgaagagtttgatcatggctcagattgaacgctggcggcaggcctaacacatgcaagtcgaacggtaacagggagcagcttgctgctctgctgacgagtggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgttgtggttaataaccacagcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggt

SEQ ID NO: 3045 - DNA, 1553 bp, Cronobacter muytjensii
  ref <308>: DATABASE ACCESSION NUMBER: NCBI ACCESSION: NZ_MSAE01000044.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggggttaaggttaataaccttggccattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcacgtcatggtgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgcaaga

SEQ ID NO: 3046 - DNA, 1552 bp, Cronobacter sakazakii
  ref <308>: DATABASE ACCESSION NUMBER: NCBI ACCESSION: NZ_UFYB01000003.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgaacggtaacagggagcagcttgctgctctgctgacgagtggcggacgggtgagtaatgtctgggaaactgcctgatggagggggataactactggaaacggtagctaataccgcataacgtctacggaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggttgattaagtcagatgtgaaatccccgggctcaacctgggaactgcatttgaaactggtcagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgcaaga

SEQ ID NO: 3047 - DNA, 1553 bp, Cronobacter turicensis
  ref <308>: DATABASE ACCESSION NUMBER: NCBI ACCESSION: NZ_NRJK01000004.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgaacggtaacagggagcagcttgctgctctgctgacgagtggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggggttgtggttaataaccgcagtcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaaga

SEQ ID NO: 3048 - DNA, 1553 bp, Cronobacter universalis
  ref <308>: DATABASE ACCESSION NUMBER: NCBI ACCESSION: NZ_UFYH01000001.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgaacggtaacagggagcagcttgctgctctgctgacgagtggcggacgggtgagtaatgtctgggaaactgcctgatggagggggataactactggaaacggtagctaataccgcataacgtcttcggaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaagggattgtggttaataaccgcagtcattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccagagaatcctgcagagatgcgggagtgccttcgggaactctgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgaccagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaaga

SEQ ID NO: 3049 - DNA, 1528 bp, Cryobacterium arcticum
  ref <308>: DATABASE ACCESSION NUMBER: NCBI ACCESSION: NZ_QHLY01000006.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacggtgatgaggagcttgcttctctgatcagtggcgaacgggtgagtaacacgtgagtaacctgcccccgactctgggataagcactggaaacggtgtctaataccggatacgagcttcagccgcatggctaggagttggaaagaatttcggttggggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggctggaaacagtcgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggccaaacccgcaagggatggagctgtcgaaggtgggatcggtgattaggactaagtcgtaacaaggtagccgtaccggaaggtgcggctggatcacctcctttctaagga

SEQ ID NO: 3050 - DNA, 1528 bp, Cryobacterium sp. GCJ02
  ref <308>: DATABASE ACCESSION NUMBER: NCBI ACCESSION: NZ_CP030033.1
  ref <309>: DATABASE ENTRY DATE: 2019-04-01
  ref <313>: RELEVANT RESIDUES IN SEQ ID NO: (1)..(1528)
tttacggagagtttgatcctggctcaggacgaacgctggcggcgtgcttaacacatgcaagtcgaacggtgaagaggagcttgctccttggatcagtggcgaacgggtgagtaacacgtgagtaacctgccccaaactctgggataagcactggaaacggtgtctaataccggatacgagcttcagccgcatggctaggagttggaaagaatttcggtttgggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggctggaaacagtcgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggccaaacccgcaagggatggagctgtcgaaggtgggatcggtgattaggactaagtcgtaacaaggtagccgtaccggaaggtgcggctggatcacctcctttctaagga

SEQ ID NO: 3051 - DNA, 1541 bp, Cryobacterium sp. Hh39
  ref <308>: DATABASE ACCESSION NUMBER: NCBI ACCESSION: NZ_QZVS01000087.1
  ref <309>: DATABASE ENTRY DATE: 2019-04-01
  ref <313>: RELEVANT RESIDUES IN SEQ ID NO: (1)..(1541)
tttacggagagtttgatcctggctcaggacgaacgctggcggcgtgcttaacacatgcaagtcgaacggtgaagaggagcttgctccttggatcagtggcgaacgggtgagtaacacgtgagcaatctgcccttgactctgggataactgcgggaaactgtagctaataccggatacgacctgaagaggcatctttttgggtggaaagaattttggtcaaggatgagctcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgaaggccttcgggttgtaaacctcttttagtagggaagaagcgactgggttttcctggaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatataccggaaacggccagaaatggtcgccccgcaaggtcggtatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcgataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccgtaaggggaggagctgtcgaaggtgggatcggtgattaggactaagtcgtaacaaggtagccgtaccggaaggtgcggctggatcacctcctttctaagga

SEQ ID NO: 3052 - DNA, 1530 bp, Cryobacterium sp. LW097
  ref <308>: DATABASE ACCESSION NUMBER: NCBI ACCESSION: NZ_CP021992.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacggtgacgagggagcttgctccttctgatcagtggcgaacgggtgagtaacacgtgagtaacctgcccttgactctgggataagcactggaaacggtgtctaataccggatacgaacttcagccgcatggctaggagttggaaagaatttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggctggaaacagtcgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggccaaacccgcaagggatggagctgtcgaaggtgggatcggtgattaggactaagtcgtaacaaggtagccgtaccggaaggtgcggctggatcacctcctttctaagga

SEQ ID NO: 3053 - DNA, 1529 bp, Cryobacterium sp. M23
  ref <308>: DATABASE ACCESSION NUMBER: NCBI ACCESSION: NZ_PJJV01000011.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacggtgatgaggagcttgctcttttgatcagtggcgaacgggtgagtaacacgtgagcaatctgcccttgactctgggataagcgttggaaacgacgtctaataccggatacgaccttggaaggcatcttctggggtggaaagaattttggtcaaggatgagctcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagtagggaagaagcgttaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggttggaaacagtcgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccgcaaggggaggagctgtcgaaggtgggatcggtgattaggactaagtcgtaacaaggtagccgtaccggaaggtgcggctggatcacctcctttctaagga

SEQ ID NO: 3054 - DNA, 1529 bp, Cryobacterium sp. M25; identical to SEQ ID NO: 3053
  ref <308>: DATABASE ACCESSION NUMBER: NCBI ACCESSION: NZ_PJJU01000005.1
  ref <309>: DATABASE ENTRY DATE: 2019-04-01
  ref <313>: RELEVANT RESIDUES IN SEQ ID NO: (1)..(1529)

SEQ ID NO: 3055 - DNA, 1529 bp, Cryobacterium sp. M96
  ref <308>: DATABASE ACCESSION NUMBER: NCBI ACCESSION: NZ_PJJS01000003.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacggtgatgaggagcttgcttctctgatcagtggcgaacgggtgagtaacacgtgagcaatctgcccttgactctgggataagcgttggaaacgacgtctaataccggatacgaccttggaaggcatcttctggggtggaaagaattttggtcaaggatgagctcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggacgacggccttcgggttgtaaacctcttttagtagggaagaagcgtaaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggttggaaacagtcgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcctaacccgcaaggggaggagctgtcgaaggtgggatcggtgattaggactaagtcgtaacaaggtagccgtaccggaaggtgcggctggatcacctcctttctaagga

SEQ ID NO: 3056 - DNA, 1530 bp, Cryobacterium sp. N22; identical to SEQ ID NO: 3052
  ref <308>: DATABASE ACCESSION NUMBER: NCBI ACCESSION: NZ_PJJP01000004.1
  ref <309>: DATABASE ENTRY DATE: 2019-04-01
  ref <313>: RELEVANT RESIDUES IN SEQ ID NO: (1)..(1530)

SEQ ID NO: 3057 - DNA, 1512 bp, Cryobacterium sp. NEAU-85
  ref <308>: DATABASE ACCESSION NUMBER: NCBI ACCESSION: NZ_RDSR01000026.1
  ref <309>: DATABASE ENTRY DATE: 2019-04-01
  ref <313>: RELEVANT RESIDUES IN SEQ ID NO: (1)..(1512)
tttgatcctggctcaggacgaacgctggcggcgtgcttaacacatgcaagtcgaacggtgacccaggagcttgctcctggtgatcagtggcgaacgggtgagtaacacgtgagcaatctgcccttgactctgggataagcgttggaaacgacgtctaataccggatacgaccctcggaggcatctcctgggggtggaaagaattttggtcaaggatgagctcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggaactagatgtgggggccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggccagaaatggtcgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggcccaaccttttggagggagctgtcgaaggtggtatcggtgattaggactaagtcgtaacaaggtagccgtaccggaaggtgcggctggatcacctcctttgc

SEQ ID NO: 3058 - DNA, 1530 bp, Cryobacterium sp. SO1
  ref <308>: DATABASE ACCESSION NUMBER: NCBI ACCESSION: NZ_MQTR01000073.1
  ref <309>: DATABASE ENTRY DATE: 2019-04-01
  ref <313>: RELEVANT RESIDUES IN SEQ ID NO: (1)..(1530)
tttacggagagtttgatcctggctcaggacgaacgctggcggcgtgcttaacacatgcaagtcgaacggtgatgagggagcttgcttcttctgatcagtggcgaacgggtgagtaacacgtgagtaacctgccccaaactctgggataagcactggaaacggtgtctaataccggatacgagcttcagccgcatggctaggagttggaaagaatttcggtttgggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggctggaaacagttgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggccaaacccgtaagggatggagctgtcgaaggtgggatcggtgattaggactaagtcgtaacaaggtagccgtaccggaaggtgcggctggatcacctcctttctaagga

SEQ ID NO: 3059 - DNA, 1316 bp, Cryobacterium zongtaii
  ref <308>: DATABASE ACCESSION NUMBER: NCBI ACCESSION: NZ_PPXE01000030.1
  ref <309>: DATABASE ENTRY DATE: 2019-04-01
  ref <313>: RELEVANT RESIDUES IN SEQ ID NO: (1)..(1316)
ttcggtcaaggatggactcgcggcctatcagctagttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccaatggcgaaggcagatctctgggccgtaactgacgctgaggagcgaaagcatggggagcgaacaggattagataccctggtagtccatgccgtaaacgttgggaactagatgtggggaccattccacggtctccgtgtcgcagctaacgcattaagttccccgcctggggagtacggccgcaaggctaaaactcaaaggaattgacgggggcccgcacaagcggcggagcatgcggattaattcgatgcaacgcgaagaaccttaccaaggcttgacatatagaggaaacggctggaaacagtcgccccgcaaggtctctatacaggtggtgcatggttgtcgtcagctcgtgtcgtgagatgttgggttaagtcccgcaacgagcgcaaccctcgtcctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgcaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccagtggccaaacccgcaagggatggagctgtcgaaggtgggatcggtgattaggactaagtcgtaacaaggtagccgtaccggaaggtgcggctggatcacctcctttctaagga

SEQ ID NO: 3060 - DNA, 1487 bp, Cucumibacter marinus
  ref <308>: DATABASE ACCESSION NUMBER: NCBI ACCESSION: NZ_KE386979.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcctaacacatgcaagtcgaacgcaccttcgggtgagtggcagacgggtgagtaacgcgtgggaatctacccatccctacggaatagctccgggaaactggaattaataccgtatacgcccttcgggggaaagattcatcggggttggatgagcccgcgttagattagctagttggtggggtaaaggcctaccaaggcgacgatctatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcagtggggaagataatgacggtacccacagaagaagccccggctaacttcgtgccagcagccgcggtaatacgaagggggctagcgttgttcggaattactgggcgtaaagcgcgcgtaggcggattgtttagtcaggggtgaaatcccggagctcaactccggaactgcctttgatactggcaatcttgagtccgggagaggtgtacggaattcctagtgtagaggtggaattcgtagatattaggaagaacaccagtggcgaaggcggtacactggcccggtactgacgctgaggcgcgaaagcgtggggagcaaacaggattagataccctggtagtccacgccgtaaactatgagagctagccgttggggggtttacccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagctcttgacatcctgatcgcggttagtggagacactttccttcagttcggctggatcagtgacaggtattgcatggctgtcgtcagctcgtgtcgtgagatgttgggttaagtcccgcaacgagcgcaaccctcgcccttagttgccagcatttagttgggcactctaaggggaccgccggtgataagccggaggaaggtggggatgaggtcaagtcatcatggtccttacgggctgggctacacacgtgctacaatggcggtgacagagggcagctacacagcgatgtgacgctaatccctaaaaaccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaaggcgctgcgctaacttttgaggcaggcgaccacggtagggtcagcgactggggtgaagtcgtaacaaggtagccgtaggggaacctgcggctggatcacctcctttctaagg

SEQ ID NO: 3061 - DNA, 1543 bp, Cupriavidus oxalaticus
  ref <308>: DATABASE ACCESSION NUMBER: NCBI ACCESSION: NZ_LT978515.1
  ref <309>: DATABASE ENTRY DATE: 2019-04-01
  ref <313>: RELEVANT RESIDUES IN SEQ ID NO: (1)..(1543)
agattgaactgaagagtttgatcctggctcagattgaacgctggcggcatgccttacacatgcaagtcgaacggcagcacgggcttcggcctggtggcgagtggcgaacgggtgagtaatacatcggaacgtgccctgtcgtgggggataactagtcgaaagattagctaataccgcatacgacctgagggtgaaagcgggggaccggcaacggcctcgcgcgacaggagcggccgatgtctgattagctagttggtggggtaagagcctaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacgcgctggttaatacctggcgtggatgacggtaccggaagaataagcaccggctaactacgtgccagcagccgcggtaatacgtagggtgcgagcgttaatcggaattactgggcgtaaagcgtgcgcaggcggtttgataagacaggcgtgaaatccccgagctcaacttgggaatggcgcttgtgactgtcaggctagagtatgtcagaggggggtagaattccacgtgtagcagtgaaatgcgtagagatgtggaggaataccgatggcgaaggcagccccctgggacgtgactgacgctcatgcacgaaagcgtggggagcaaacaggattagataccctggtagtccacgccctaaacgatgtcaactagttgttggggattcatttcttcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcatcaggtgcccgaaagggaaagtggacacaggtgctgcatggctgtcgtcagctcgtgtcgtgagatgttgggttaagtcccgcaacgagcgcaacccttgtctctagttgctacgcaagagcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtagccgtatcggaaggtgcggctggatcacctcctttccag

SEQ ID NO: 3062 - DNA, 1541 bp, Cupriavidus pauculus
  ref <308>: DATABASE ACCESSION NUMBER: NCBI ACCESSION: NZ_CP033969.1
  ref <309>: DATABASE ENTRY DATE: 2019-04-01
  ref <313>: RELEVANT RESIDUES IN SEQ ID NO: (1)..(1541)
agattgaactgaagagtttgatcctggctcagattgaacgctggcggcatgccttacacatgcaagtcgaacggcagcgcggacttcggtctggcggcgagtggcgaacgggtgagtaatacatcggaacgtaccctgttgtgggggataactagtcgaaagattagctaataccgcatacgacctgagggtgaaagcgggggaccgtaaggcctcgcgcagcaggagcggccgatgtctgattagctagttggtggggtaaaggctcaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaaacgttctggttaatacctggggcggatgacggtaccggaagaataagcaccggctaactacgtgccagcagccgcggtaatacgtagggtgcgagcgttaatcggaattactgggcgtaaagcgtgcgcaggcggttttgtaagacaggcgtgaaatccccgggcttaacctgggaattgcgcttgtgactgcaaggctagagtgcgtcagaggggggtagaattccacgtgtagcagtgaaatgcgtagagatgtggaggaataccgatggcgaaggcagccccctgggacgtgactgacgctcatgcacgaaagcgtggggagcaaacaggattagataccctggtagtccacgccctaaacgatgtcaactagttgttggggattcattttctcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgcccgaaagggaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgcagtctgcaactcgactgcgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtagccgtatcggaaggtgcggctggatcacctcctttccag

SEQ ID NO: 3063 - DNA, 1539 bp, Cupriavidus plantarum
  ref <308>: DATABASE ACCESSION NUMBER: NCBI ACCESSION: NZ_RCCX01000012.1
  ref <309>: DATABASE ENTRY DATE: 2019-04-01
  ref <313>: RELEVANT RESIDUES IN SEQ ID NO: (1)..(1539)
attgaactgaagagtttgatcctggctcagattgaacgctggcggcatgccttacacatgcaagtcgaacggcagcgcggacttcggtctggcggcgagtggcgaacgggtgagtaatacatcggaacgtgccctgttgtgggggataactagtcgaaagattagctaataccgcatacgacctgagggtgaaagcgggggaccgtaaggcctcgcgcaataggagcggccgatgtctgattagctagttggtggggtaaaggcctaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaattgcgctggttaatacccggcgtagatgacggtaccggaagaataagcaccggctaactacgtgccagcagccgcggtaatacgtagggtgcgagcgttaatcggaattactgggcgtaaagcgtgcgcaggcggttttgtaagacaggcgtgaaatccccgggctcaacctgggaattgcgcttgtgactgcaaggctagagtgcgtcagaggggggtagaattccacgtgtagcagtgaaatgcgtagagatgtggaggaataccgatggcgaaggcagccccctgggacgtgactgacgctcatgcacgaaagcgtggggagcaaacaggattagataccctggtagtccacgccctaaacgatgtcaactagttgttggggattcatttcctcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgcccgaaagggaaagtggacacaggtgctgcatggctgtcgtcagctcgtgtcgtgagatgttgggttaagtcccgcaacgagcgcaacccttgtctttagttgctacgcaagagcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtagccgtatcggaaggtgcggctggatcacctcctttccag

SEQ ID NO: 3064 - DNA, 1540 bp, Cupriavidus sp. P-10
  ref <308>: DATABASE ACCESSION NUMBER: NCBI ACCESSION: NZ_BGPQ01000101.1
  ref <309>: DATABASE ENTRY DATE: 2019-04-01
  ref <313>: RELEVANT RESIDUES IN SEQ ID NO: (1)..(1540)
agattgaactgaagagtttgatcctggctcagattgaacgctggcggcatgccttacacatgcaagtcgaacggcagcacgggcttcggcctggtggcgagtggcgaacgggtgagtaatacatcggaacgtgccctgtcgtgggggataactagtcgaaagattagctaataccgcatacgacctgagggtgaaagcgggggaccggtaacggcctcgcgcgacaggagcggccgatgtctgattagctagttggtggggtaagagcctaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatggctctggttaatacccggggtcgatgacggtaccggaagaataagcaccggctaactacgtgccagcagccgcggtaatacgtagggtgcgagcgttaatcggaattactgggcgtaaagcgtgcgcaggcggtttgataagacaggcgtgaaatccccgagcttaacttgggaatggcgcttgtgactgtcaggctagagtatgtcagaggggggtagaattccacgtgtagcagtgaaatgcgtagagatgtggaggaataccgatggcgaaggcagccccctgggacgtcactgacgctcatgcacgaaagcgtggggagcaaacaggattagataccctggtagtccacgccctaaacgatgtcaactagttgttggggattcatttcttcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcatcaggtgcccgaaagggaaagtggacacaggtgctgcatggctgtcgtcagctcgtgtcgtgagatgttgggttaagtcccgcaacgagcgcaacccttgtctctagttgctacgcaagagcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtagccgtatcggaaggtgcggctggatcacctcctttc

SEQ ID NO: 3065 - DNA, 1076 bp, Cupriavidus sp. S23
  ref <308>: DATABASE ACCESSION NUMBER: NCBI ACCESSION: NZ_QKWJ01000246.1
  ref <309>: DATABASE ENTRY DATE: 2019-04-01
  ref <313>: RELEVANT RESIDUES IN SEQ ID NO: (1)..(1076)
taatacctcgggtcgatgacggtaccggaagaataagcaccggctaactacgtgccagcagccgcggtaatacgtagggtgcgagcgttaatcggaattactgggcgtaaagcgtgcgcaggcggttttgtaagacaggcgtgaaatccccgagctcaacttgggaatggcgcttgtgactgcaaggctagagtatgtcagaggggggtagaattccacgtgtagcagtgaaatgcgtagagatgtggaggaataccgatggcgaaggcagccccctgggacgtcactgacgctcatgcacgaaagcgtggggagcaaacaggattagataccctggtagtccacgccctaaacgatgtcaactagttgttggggattcatttcttcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgcccgaaagggaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtagccgtatcggaaggtgcggctggatcacctcctttc

SEQ ID NO: 3066 - DNA, 1541 bp, Cupriavidus taiwanensis
  ref <308>: DATABASE ACCESSION NUMBER: NCBI ACCESSION: NZ_LT984806.1
  ref <309>: DATABASE ENTRY DATE: 2019-04-01
  ref <313>: RELEVANT RESIDUES IN SEQ ID NO: (1)..(1541)
agattgaactgaagagtttgatcctggctcagattgaacgctggcggcatgccttacacatgcaagtcgaacggcagcgcgggcttcggcctggcggcgagtggcgaacgggtgagtaatacatcggaacgtgccctgtcgtgggggataactagtcgaaagattagctaataccgcatacgacctgagggtgaaagcgggggaccgtaaggcctcgcgcgataggagcggccgatgtctgattagctagttggtggggtaaaggcctaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatggcgctggctaatacccggcgtcgatgacggtaccggaagaataagcaccggctaactacgtgccagcagccgcggtaatacgtagggtgcgagcgttaatcggaattactgggcgtaaagcgtgcgcaggcggtttgataagacaggcgtgaaatccccgagctcaacttgggaatggcgcttgtgactgtcaggctagagtatgtcagaggggggtagaattccacgtgtagcagtgaaatgcgtagagatgtggaggaataccgatggcgaaggcagccccctgggacgtcactgacgctcatgcacgaaagcgtggggagcaaacaggattagataccctggtagtccacgccctaaacgatgtcaactagttgttggggattcatttcttcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgcccgaaagggaaagtggacacaggtgctgcatggctgtcgtcagctcgtgtcgtgagatgttgggttaagtcccgcaacgagcgcaacccttgtctctagttgctacgaaagggcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtagccgtatcggaaggtgcggctggatcacctcctttccag

SEQ ID NO: 3067 - DNA, 1529 bp, Curtobacterium flaccumfaciens
  ref <308>: DATABASE ACCESSION NUMBER: NCBI ACCESSION: NZ_PUEZ01000003.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtagccgtaccggaaggtgcggctggatcacctcctttctaagga

SEQ ID NO: 3068 - DNA, 1529 bp, Curtobacterium sp. HSID17257
  ref <308>: DATABASE ACCESSION NUMBER: NCBI ACCESSION: NZ_RBLU01000169.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtagccgtaccggaaggtgcggctggatcacctcctttctaagga

SEQ ID NO: 3069 - DNA, 1529 bp, Curtobacterium sp. JUb34; identical to SEQ ID NO: 3067
  ref <308>: DATABASE ACCESSION NUMBER: NCBI ACCESSION: NZ_RJVH01000007.1
  ref <309>: DATABASE ENTRY DATE: 2019-04-01
  ref <313>: RELEVANT RESIDUES IN SEQ ID NO: (1)..(1529)

SEQ ID NO: 3070 - DNA, 1529 bp, Curtobacterium sp. PhB115; identical to SEQ ID NO: 3067
  ref <308>: DATABASE ACCESSION NUMBER: NCBI ACCESSION: NZ_RJKR01000002.1
  ref <309>: DATABASE ENTRY DATE: 2019-04-01
  ref <313>: RELEVANT RESIDUES IN SEQ ID NO: (1)..(1529)

SEQ ID NO: 3071 - DNA, 1529 bp, Curtobacterium sp. PhB130
  ref <308>: DATABASE ACCESSION NUMBER: NCBI ACCESSION: NZ_RKII01000002.1
  ref <309>: DATABASE ENTRY DATE: 2019-04-01
  ref <313>: RELEVANT RESIDUES IN SEQ ID NO: (1)..(1529)
tttacggagagtttgatcctggctcaggacgaacgctggcggcgtgcttaacacatgcaagtcgaacgatgatgcccagcttgctgggcggattagtggcgaacgggtgagtaacacgtgagtaacctgcccctgactctgggataagcgttggaaacgacgtctaatactggatatgatcaccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtagccgtaccggaaggtgcggctggatcacctcctttctaagga

SEQ ID NO: 3072 - DNA, 1171 bp, Curtobacterium sp. PhB131
  ref <308>: DATABASE ACCESSION NUMBER: NCBI ACCESSION: NZ_RKHZ01000015.1
  ref <309>: DATABASE ENTRY DATE: 2019-04-01
  ref <313>: RELEVANT RESIDUES IN SEQ ID NO: (1)..(1171)
gaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtagccgtaccggaaggtgcggctggatcacctcctttctaagga

SEQ ID NO: 3073 - DNA, 1319 bp, Curtobacterium sp. PhB137
  ref <308>: DATABASE ACCESSION NUMBER: NCBI ACCESSION: NZ_RKQO01000005.1
  ref <309>: DATABASE ENTRY DATE: 2019-04-01
  ref <313>: RELEVANT RESIDUES IN SEQ ID NO: (1)..(1319)
ttttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtagccgtaccggaaggtgcggctggatcacctcctttctaagga

SEQ ID NO: 3074 - DNA, 1075 bp, Curtobacterium sp. PhB141
  ref <308>: DATABASE ACCESSION NUMBER: NCBI ACCESSION: NZ_RKIH01000008.1
  ref <309>: DATABASE ENTRY DATE: 2019-04-01
  ref <313>: RELEVANT RESIDUES IN SEQ ID NO: (1)..(1075)
agtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgggatcggtgattaggactaagtcgtaacaaggtagccgtaccggaaggtgcggctggatcacctcctttctaagga

SEQ ID NO: 3075 - DNA, 1075 bp, Curtobacterium sp. PhB170; identical to SEQ ID NO: 3074
  ref <308>: DATABASE ACCESSION NUMBER: NCBI ACCESSION: NZ_RJUM01000005.1
  ref <309>: DATABASE ENTRY DATE: 2019-04-01
  ref <313>: RELEVANT RESIDUES IN SEQ ID NO: (1)..(1075)

SEQ ID NO: 3076 - DNA, 1171 bp, Curtobacterium sp. PhB171; identical to SEQ ID NO: 3072
  ref <308>: DATABASE ACCESSION NUMBER: NCBI ACCESSION: NZ_RJLB01000006.1
  ref <309>: DATABASE ENTRY DATE: 2019-04-01
  ref <313>: RELEVANT RESIDUES IN SEQ ID NO: (1)..(1171)

SEQ ID NO: 3077 - DNA, 1529 bp, Curtobacterium sp. PhB172; identical to SEQ ID NO: 3067
  ref <308>: DATABASE ACCESSION NUMBER: NCBI ACCESSION: NZ_RKIF01000003.1
  ref <309>: DATABASE ENTRY DATE: 2019-04-01
  ref <313>: RELEVANT RESIDUES IN SEQ ID NO: (1)..(1529)

SEQ ID NO: 3078 - DNA, 1075 bp, Curtobacterium sp. PhB78; identical to SEQ ID NO: 3074
  ref <308>: DATABASE ACCESSION NUMBER: NCBI ACCESSION: NZ_RKIA01000013.1
  ref <309>: DATABASE ENTRY DATE: 2019-04-01
  ref <313>: RELEVANT RESIDUES IN SEQ ID NO: (1)..(1075)

SEQ ID NO: 3079 - DNA, 1529 bp, Curtobacterium sp. ZW137; identical to SEQ ID NO: 3071
  ref <308>: DATABASE ACCESSION NUMBER: NCBI ACCESSION: NZ_RJKS01000008.1
  ref <309>: DATABASE ENTRY DATE: 2019-04-01
  ref <313>: RELEVANT RESIDUES IN SEQ ID NO: (1)..(1529)

SEQ ID NO: 3080 - DNA, 1533 bp, Cutibacterium avidum
  ref <308>: DATABASE ACCESSION NUMBER: NCBI ACCESSION: NZ_NOWI01000002.1
  ref <309>: DATABASE ENTRY DATE: 2019-04-01
  ref <313>: RELEVANT RESIDUES IN SEQ ID NO: (1)..(1533)
ttttcattggagagtttgatcctggctcaggacgaacgctggcggcgtgcttaacacatgcaagtcgaacggaaaggcccctttgggggtactcgagtggcgaacgggtgagtaacacgtgagtaacctgcccttgacttcgggataacttcaggaaactggggctaataccggataggaatccttgctgcatggtgggggttggaaagcttcggcggttttggatggactcgcggcttatcagcttgttggtggggtagtggcttaccaaggctttgacgggtagccggcctgagagggcgaccggccacattgggactgagatacggcccagactcctacgggaggcagcagtggggaatattgcacaatgggcggaagcctgatgcagcaacgccgcgtgcgggatgacggccttcgggttgtaaaccgctttcagcaggggcgaagcttttgtgacggtacctgcagaagaagcaccggctaactacgtgccagcagccgcggtgatacgtagggtgcgagcgttgtccggatttattgggcgtaaagagctcgtaggtggttgattgcgtcggaagtgaaaacttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctggtagtccacgctgtaaacggtgggtactaggtgtggggtccattccacggattccgtgccgtagctaacgcattaagtaccccgcctggggagtacggccgcaaggctaaaactcaaaggaattgacggggccccgcacaagcggcggagcatgcggattaattcgatgcaacgcgaagaaccttacctgggtttgacatggactgggagtgctcagagatgggtacgcctccttgtggggctggttcacaggtggtgcatggctgtcgtcagctcgtgtcgtgagatgttgggttaagtcccgcaacgagcgcaaccctcgttcactgttgccagcacgttatggtggggactcagtggagaccgccggggtcaactcggaggaaggtggggatgacgtcaagtcatcatgccccttatgtccagggcttcacgcatgctacaatggccggtacaaagagttgcgagcctgtgagggtgagcgaatctcggaaagccggtctcagttcggattggggtctgcaactcgaccctatgaagtcggagtcgctagtaatcgcagatcagcaacgctgcggtgaatacgttcccggggcttgtacacaccgcccgtcaagtcatgaaagtcggtaacacccgaagccggtggcctaacctgtgtgggggagccgtcgaaggtgggactggtaattaggactaagtcgtaacaaggtagccgtaccggaaggtgcggctggatcacctcctttctaaggag

SEQ ID NO: 3081 - DNA, 1488 bp, Cyanobacterium aponinum
  ref <308>: DATABASE ACCESSION NUMBER: NCBI ACCESSION: NZ_PEBC01000075.1
  ref <309>: DATABASE ENTRY DATE: 2019-04-01
  ref <313>: RELEVANT RESIDUES IN SEQ ID NO: (1)..(1488)
atggagagtttgatcctggctcaggatgaacgctggcggtatgcctaacacatgcaagtcgaacgggctcttcggagctagtggcggacgggtgaggaacgcgtgagaacctgcctcaaggtcggggacaacagttggaaacgactgctaataccggatgagccgaataggtaaaagatttatcgcctagagaggggctcgcgtctgattagctagatggtgaggtaaaggcttaccatggcgacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaaaaaaatgacggtacctaatgtaagcatcggctaactccgtgccagcagccgcggtaatacggaggatgcaagcgttatccggaatcattgggcgtaaagagtccgtaggtggcacttcaagtctgctttcaaagaccgaagctcaacttcggaaagggagtggaaactgaagagctagagtatagtaggggtagagggaattcctagtgtagcggtgaaatgcgtagagattaggaagaacaccagtggcgaaggcgctctactgggcatatactgacactgagggacgaaagctaggggagcgaaagggattagatacccctgtagtcctagcggtaaacgatggatactaggcgtagtgctgttagaaggactgtgccgaagctaacgcgttaagtatcccgcctggggagtacgcacgcaagtgtgaaactcaaaggaattgacggggacccgcacaagcggtggagtatgtggtttaattcgatgcaacgcgaagaaccttaccaaggcttgacatcctgcgaatcttggagaaatctgagagtgcctaagggaacgcagagacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttgggacaaaggggagcgaaaccgcgaggtggagcgaatctcatcaaacccagccacagttcagattgcaggctgaaactcgcctgcatgaaggaggaatcgctagtaatcgcaggtcagcatactgcggtgaatccgttcccgggtcttgtacacaccgcccgtcacaccatggaagttggtcacgcccgaagtcgttattctaacccaagtggaaggagacgccgaaggtgggactagtgactggggtgaagtcgtaacaaggtagccgtaccggaaggtgtggctggatcacctcctttaaggg

SEQ ID NO: 3082 - DNA, 1496 bp, Cyanobacterium sp. IPPAS B-1200
  ref <308>: DATABASE ACCESSION NUMBER: NCBI ACCESSION: NZ_LWHC01000100.1
  ref <309>: DATABASE ENTRY DATE: 2019-04-01
  ref <313>: RELEVANT RESIDUES IN SEQ ID NO: (1)..(1496)
tttacaatggagagtttgatcctggctcaggatgaacgctggcggtatgcctaacacatgcaagtcgaacggtcaccttagggtgatagtggcggacgggtgagtaacacgtgagaatctgcccttaggtcggggacaacagttggaaacgactgctaataccggatgagctgaaaagtaaaagatttatcgcctagggaagagctcgcggctgattagctagttggtggggtaaaagcctaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcaaaacttagggaagaagaaagtgacggtacctaatataagcatcggctaactccgtgccagcagccgcggtaatacggaggatgcaagcgttatccggaatcattgggcgtaaagagtccgtaggtggcacttcaagtccgcatttaaagaccgaggctcaacctcgggtagggtgtggaaactgaagagctagagtacaggaggggtagagggaattcctagtgtagcggtgaaatgcgtagagattaggaagaacaccagtggcgaaggcgctctactggacatgtactgacactgagggacgaaagctagggtagcgaaagggattagatacccctgtagtcttagcggtaaacgatggatactaagtgtagcgggtataaactcctgctgtgctgaagcaaacgcgttaagtatcccgcctggggagtacgcacgcaagtgtgaaactcaaaggaattgacggggacccgcacaagcggtggagtatgtggtttaattcgatgcaacgcgaagaaccttaccaagacttgacatccgatgaatttttctgaaaggaaagagtgccttagggaacatcgtgacaggtggtgcatggctgtcgtcagctcgtgtcgtgagatgttgggttaagtcccgcaacgagcgcaaccctcgtccttagttgccagcattaagttggggactctagggagaccgccggggagaactcggaggaaggtggggatgacgtcaagtcagcatgccccttacgtcttgggctacacacgtactacaatggttaggacaaagggatgcgaaaccgcaaggtgaagcgaaacccatcaaacctagccccagttcagatcgtcggctgaaactcgccggcgtgaaggaggaatcgctagtaatcgcaggtcagcatactgcggtgaatccgttcccgggtcttgtacacaccgcccgtcacaccatggaagttggtaacatccgaagtcgttactccaacccttttggggggaggacgccgaaggtgggactagtgactggggtgaagtcgtaacaaggtagccgtaccggaaggtgtggctggatcacctccttataa

SEQ ID NO: 3083 - DNA, 1483 bp, Cyanobium gracile
  ref <308>: DATABASE ACCESSION NUMBER: NCBI ACCESSION: NC_019675.1
  ref <309>: DATABASE ENTRY DATE: 2019-04-01
  ref <313>: RELEVANT RESIDUES IN SEQ ID NO: (1)..(1483)
aacggagagtttgatcctggctcaggatgaacgctggcggcgtgcttaacacatgcaagtcgaacgagccttcgggctagtggcggacgggtgagtaacgcgtgggaatctgccctcaggagggggataacggccggaaacggccgctaataccccatatgccgagaggtgaaatgaatttcgcctgaggatgagcccgcgtctgattagctagttggtggggtaatggcccaccaaggcgacgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagacatgacggtacttgaggaataagccacggctaattccgtgccagcagccgcggtaatacgggagtggcaagcgttatccggaattattgggcgtaaagcgtccgcaggcggccttgtaagtctgtcgttaaagcgtggagcttaactccatttcagcgatggaaactacaaggcttgagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagctaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatcccttggaaacgagggagtgccttcgggagcgcagagacaggtggtgcatggctgtcgtcagctcgtgtcgtgagatgttgggttaagtcccgcaacgagcgcaacccacgtctttagttgccagcattcagttgggcactctagagagaccgccggtgataaaccggaggaaggtgtggatgacgtcaagtcatcatgccccttacatcctgggctacacacgtactacaatgctacggacaaagggttgcaagctcgcgagagttagctaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccatgcccgaagtcgttactccaacccttgtggaggaggacgccgaaggtggggctgatgactggggtgaagtcgtaacaaggtagccgtaccggaaggtgcggctggatcacctcctaa

SEQ ID NO: 3084 - DNA, 1484 bp, Cyanobium sp. NIES-981
  ref <308>: DATABASE ACCESSION NUMBER: NCBI ACCESSION: NZ_LT578417.1
  ref <309>: DATABASE ENTRY DATE: 2019-04-01
  ref <313>: RELEVANT RESIDUES IN SEQ ID NO: (1)..(1484)
aacggagagtttgatcctggctcaggatgaacgctggcggcgtgcttaacacatgcaagtcgaacgcaccttcgggtgagtggcggacgggtgagtaacgcgtgagaatctgccctcaggagggggataacggctggaaacggccgctaataccccatatgccgcgaggtgaaatgagttttcgcctgaggatgagctcgcgtctgattagctagttggtggggtaagagcctaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggtcttgaaagtctgttgttaaagcgtggagctcaactccatttaagcaatggaaactacaagactagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatccctgagaaatcggggagtgccttcgggagcgcagagacaggtggtgcatggctgtcgtcagctcgtgtcgtgagatgttgggttaagtcccgcaacgagcgcaacccacgtctttagttgccagcattaagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagtcgttactccaacccttgtggaggaggacgccgaaggtggggctgatgactggggtgaagtcgtaacaaggtagccgtaccggaaggtgcggctggatcacctcctaa

SEQ ID NO: 3085 - DNA, 1484 bp, Cyanobium sp. PCC 7001
  ref <308>: DATABASE ACCESSION NUMBER: NCBI ACCESSION: NZ_DS990556.1
  ref <309>: DATABASE ENTRY DATE: 2019-04-01
  ref <313>: RELEVANT RESIDUES IN SEQ ID NO: (1)..(1484)
aacggagagtttgatcctggctcaggatgaacgctggcggcgtgcttaacacatgcaagtcgaacgcaccttcgggtgagtggcggacgggtgagtaacgcgtgagaatctgccccaaggagggggataacggctggaaacggccgctaataccccatatgccgagaggtgaaacgagtattcgccttgggatgagctcgcgtctgattagctagttggtggggtaagagcctaccaaggcatcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttctcaaggaagaagatctgacggtacttgaggaataagccacggctaattccgtgccagcagccgcggtaatacgggagtggcaagcgttatccggaattattgggcgtaaagcgtccgcaggcggccttgaaagtctgttgttaaagcgtggagcttaactccatttcagcaatggaaactagaaggctagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatcccttggaaacttgggagtgccttcgggagcgcagagacaggtggtgcatggctgtcgtcagctcgtgtcgtgagatgttgggttaagtcccgcaacgagcgcaacccacgtctttagttgccagcattgagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagtcgttactccaacccttgtggaggaggacgccgaaggtggggctgatgactggggtgaagtcgtaacaaggtagccgtaccggaaggtgcggctggatcacctcctaa

SEQ ID NO: 3086 - DNA, 1485 bp, Cyanobium usitatum
  ref <308>: DATABASE ACCESSION NUMBER: NCBI ACCESSION: NZ_PXXO01000003.1
  ref <309>: DATABASE ENTRY DATE: 2019-04-01
  ref <313>: RELEVANT RESIDUES IN SEQ ID NO: (1)..(1485)
acaacggagagtttgatcctggctcaggatgaacgctggcggcgtgcttaacacatgcaagtcgaacgaaccttcgggttagtggcggacgggtgagtaacgcgtgagaatctgcccttaggagggggataacggctggaaacggccgctaataccccatatgccgagaggtgaaatgaatttcgcctgaggatgagctcgcgtctgattagctagttggtgtggtaaaggctcaccaaggcttcgatcagtagctggtctgagaggatgatcagccacactgggactgagacacggcccagactcctacgggaggcagcagtggggaattttccgcaatgggcgcaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggttttacaagtctgtcgttaaaacgtggagctcaactccatttcggcgatggaaactgtaagactagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaattccttggaaacttggaagtgccttcgggagcgcagtgacaggtggtgcatggctgtcgtcagctcgtgtcgtgagatgttgggttaagtcccgcaacgagcgcaacccacgtctttagttgccagcattaagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagtcgttactccaacccttgtggaggaggatgccgaaggtggggctgatgactggggtgaagtcgtaacaaggtagccgtaccggaaggtgcggctggatcacctcctaa

SEQ ID NO: 3087 - DNA, 638 bp, Cyanosarcina burmensis
  ref <308>: DATABASE ACCESSION NUMBER: NCBI ACCESSION: NZ_PVWL01000023.1
  ref <309>: DATABASE ENTRY DATE: 2019-04-01
  ref <313>: RELEVANT RESIDUES IN SEQ ID NO: (1)..(638)
actcaaaggaattgacgggggcccgcacaagcggtggagtatgtggtttaattcgatgcaacgcgaagaaccttaccagggcttgacatgtctggaacccgtgggaaactatggggtgccgaaaggagccagaacacaggtggtgcatggctgtcgtcagctcgtgtcgtgagatgttgggttaagtcccgcaacgagcgcaaccctcgtgtttagttgccatcattcagttgggcactctagacagactgccggtgacaaaccggaggaaggtggggatgacgtcaagtcagcatgccccttacgtcctgggcgacacacgtactacaatgctacggacaacgggaagccaaccagcgatggggagcaaagcccagcaaaccgtagctcagttcagatcgcaggctgcaactcgcctgcgtgaaggcggaatcgctagtaatcgccggtcagccatacggcggtgaatacgttcccgggccttgtacacaccgcccgtcacaccatggaagttggccacgcccgaagtcattactctaaccattcgtggaggaggatgccgaaggcagggctgatgactggggtgaagtcgtaacaaggtagccgtaccggaaggtgtggctggatcacctccttta

SEQ ID NO: 3088 - DNA, 1485 bp, Cyanothece sp. ATCC 51142
  ref <308>: DATABASE ACCESSION NUMBER: NCBI ACCESSION: NC_010546.1
  ref <309>: DATABASE ENTRY DATE: 2019-04-01
  ref <313>: RELEVANT RESIDUES IN SEQ ID NO: (1)..(1485)
cacggagagtttgatcctggctcaggatgaacgctggcggtatgcctaacacatgcaagtcgaacgaagtcttcggactgagtggcggacgggtgagtaacgcgtgagaatctgccttcaggatggggataacagtgggaaaccaatgctaatacccaatatgccgaaaggtgaaaattattttgcctggagaggagctcgcgtctgattagctagttggtggggtaaaagcttaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggcctttgggttgtaaacctcttttctcagggaagaagatctgacggtacctgaggaataagcatcggctaactccgtgccagcagccgcggtaatacggaggatgcaagcgttatccggaattattgggcgtaaagcgtccgcaggtggtttttcaagtctgctgtcaaagaccagagctcaactctggaccggcagtggaaactgggaaactagagtccggtaggggtagcgggaattcccagtgtagcggtgaaatgcgtagatattgggaagaacatcggtggcgaaggcgcgctactggaccggaactgacactcagggacgaaagctaggggagcgaaagggattagatacccctgtagtcctagctgtaaacgatggaaactaggtgtggcttgtatcgacccgagccgtgccgtagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaactttcctgaaagggaaaggtgccttcgggaaccggaacacaggtggtgcatggctgtcgtcagctcgtgtcgtgagatgttgggttaagtcccgcaacgagcgcaaccctcgtctttagttgccagcattaaggtgggcactctagagagactgccggtgacaaaccggaggaaggtggggatgacgtcaagtcagcatgccccttacgccctgggctacacacgtactacaatggttgggacaaagggcagcgaacccgcgagggagagcgaatctcatcaaacccagcctcagttcagattgctctctgcaactcgagagcatgaaggaggaatcgctagtaatcgcaggtcagcatactgcggtgaattcgttcccgggccttgtacacaccgcccgtcacaccatggaagctggtcacgcccgaagtagttaccctaactttcgagagggggactcctaaggcagggctagtgactggggtgaagtcgtaacaaggtagccgtaccggaaggtgtggctggatcacctcctta

SEQ ID NO: 3089 - DNA, 1485 bp, Cyanothece sp. ATCC 51472; identical to SEQ ID NO: 3088
  ref <308>: DATABASE ACCESSION NUMBER: NCBI ACCESSION: NZ_AGJC02000001.1
  ref <309>: DATABASE ENTRY DATE: 2019-04-01
  ref <313>: RELEVANT RESIDUES IN SEQ ID NO: (1)..(1485)

SEQ ID NO: 3090 - DNA, 1485 bp, Cyanothece sp. BG0011
  ref <308>: DATABASE ACCESSION NUMBER: NCBI ACCESSION: NZ_PRLH01000085.1
  ref <309>: DATABASE ENTRY DATE: 2019-04-01
  ref <313>: RELEVANT RESIDUES IN SEQ ID NO: (1)..(1485)
cacggagagtttgatcctggctcaggatgaacgctggcggtatgcctaacacatgcaagtcgaacgcagtcttcggactgagtggcggacgggtgagtaacgcgtgagaatctgccttcaggatggggataacagtgggaaaccactgctaatacccaatatgccgaaaggtgaaaattattttgcctgaagaggagctcgcgtctgattagctagttggtggggtaaaagcttaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggcctttgggttgtaaacctcttttctcagggaagaagatctgacggtacctgaggaataagcatcggctaactccgtgccagcagccgcggtaatacggaggatgcaagcgttatccggaattattgggcgtaaagcgtccgcaggtggtttttcaagtctgctgtcaaagaccgaagctcaacttcggaaaggcagtggaaactggaaaactagagttcggtaggggtagcgggaattcccagtgtagcggtgaaatgcgtagatattgggaagaacatcggtggcgaaggcgcgctactggaccgaaactgacactcagggacgaaagctaggggagcgaaagggattagatacccctgtagtcctagctgtaaacgatggaaactaggtgtggcttgtatcgacccgagccgtgccgtagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaactttcctgaaagggaaaggtgccttcgggaaccggaacacaggtggtgcatggctgtcgtcagctcgtgtcgtgagatgttgggttaagtcccgcaacgagcgcaaccctcgtctttagttgccagcattaaggtgggcactctagagagactgccggtgacaaaccggaggaaggtggggatgacgtcaagtcagcatgccccttacgccctgggctacacacgtactacaatggttgggacaaagggcagcgaacccgcgagggaaagcgaatctcatcaaacccagcctcagttcagattgctctctgcaactcgagagcatgaaggaggaatcgctagtaatcgcaggtcagcatactgcggtgaattcgttcccgggccttgtacacaccgcccgtcacaccatggaagctggtcacgcccgaagtagttaccctaactttcgagagggggactcctaaggcagggctagtgactggggtgaagtcgtaacaaggtagccgtaccggaaggtgtggctggatcacctcctta

SEQ ID NO: 3091 - DNA, 1486 bp, Cyanothece sp. CCY0110
  ref <308>: DATABASE ACCESSION NUMBER: NCBI ACCESSION: NZ_AAXW01000006.1
  ref <309>: DATABASE ENTRY DATE: 2019-04-01
  ref <313>: RELEVANT RESIDUES IN SEQ ID NO: (1)..(1486)
cacggagagtttgatcctggctcaggatgaacgctggcggtatgcctaacacatgcaagtcgaacgaagtcttcggacttagtggcggacgggtgagtaacgcgtgagaatctgccttcaggatggggataacagtgggaaaccaatgctaatacccaatatgccgaaaggtgaaaattattttgcctgaagaggagctcgcgtctgattagctagttggtggggtaagagcttaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggcctttgggttgtaaacctcttttctcagggaagaagatctgacggtacctgaggaataagcatcggctaactccgtgccagcagccgcggtaatacggaggatgcaagcgttatccggaattattgggcgtaaagcgtccgcaggtggtttttcaagtctgctgtcaaagaccagagctcaactctgggccggcagtggaaactgggaaactagagttcggtaggggtagcgggaattcccagtgtagcggtgaaatgcgtagatattgggaagaacatcggtggcgaaggcgcgctactggaccgaaactgacactcagggacgaaagctaggggagcgaaagggattagatacccctgtagtcctagctgtaaacgatggaaactaggtgtggcttgtatcgacccgagccgtgccgtagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaactttcctgaaagggaaaggtgccttcgggagccggaacacaggtggtgcatggctgtcgtcagctcgtgtcgtgagatgttgggttaagtcccgcaacgagcgcaaccctcgtctttagttgccagcattaaggtgggcactctagagagactgccggtgacaaaccggaggaaggtggggatgacgtcaagtcagcatgccccttacgccctgggctacacacgtactacaatggttgggacaaagggcagcgaacccgcgagggaaagcgaatctcatcaaacccagcctcagttcagattgctctctgcaactcgagagcatgaaggaggaatcgctagtaatcgcaggtcagcatactgcggtgaattcgttcccgggccttgtacacaccgcccgtcacaccatggaagctggtcacgcccgaagtagttaccctaactttcgagagggggactcctaaggcagggctagtgactggggtgaagtcgtaacaaggtagccgtaccggaaggtgtggctggatcacctccttat

SEQ ID NO: 3092 - DNA, 1497 bp, Cyanothece sp. PCC 7424
  ref <308>: DATABASE ACCESSION NUMBER: NCBI ACCESSION: NC_011729.1
  ref <309>: DATABASE ENTRY DATE: 2019-04-01
  ref <313>: RELEVANT RESIDUES IN SEQ ID NO: (1)..(1497)
catggagagtttgatcctggctcaggatgaacgctggcggcgtgcctaacacatgcaagtcgaacgggggtgaaaaccctagtggcggacgggtgagtaacgcgtgagaatctgcctacaggatggggataacagacggaaacggctgctaatacccaatgagccgagaggtaaaaggatttattgcctgaagaggagctcgcgtctgattagctagttggtggggtaaaagcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggctcttgggttgtaaacctcttttgttagggaagaagcaagtgacggtacctaacgaatcagcatcggctaactccgtgccagcagccgcggtaatacggaggatgcaagcgttatccggaattattgggcgtaaagcgtccgtaggtggttgttcaagtcggctgtcaaagaccgaagcttaacttcgggcaggcggtggaaactgaagaactagagaccagtaggggtagcgggaattcccagtgtagcggtgaaatgcgtagagattgggaagaacatcggtggcgaaagcgcgctactgggctggggctgacactgagggacgaaagctaggggagcgaaagggattagatacccctgtagtcctagctgtaaacgatggagactaggcgtagattgtatcgacccaagctgtgccgaagctaacgcgttaagtctcccgcctggggagtacgcacgcaagtgtgaaactcaaaggaattgacgggggcccgcacaagcggtggagtatgtggtttaattcgatgcaacgcgaagaaccttaccagggcttgacatctgtagaaccccttggaaacaggggggtgccttcgggagctacaagacaggtggtgcatggctgtcgtcagctcgtgtcgtgagatgttgggttaagtcccgcaacgagcgcaaccctcgtccttagttgccagcattaagttgggcactctagggagactgccggtgacaaaccggaggaaggtggggatgacgtcaagtcagcatgccccttacgtcctgggcgacacacgtactacaatggtcgggacaaagggcagcgaacccgcgagggcaagcgaatctcaacaaacccggcctcagttcagattgctctgtgcaactcgagagcatgaaggaggaatcgctagtaatcgccggtcagcatacggcggtgaattcgttcccgggccttgtacacaccgcccgtcacaccatggaagctggccacgcccgaagtcgttaccctaacctttcgaggagggggatgccgaaggcagggctggtgactggggtgaagtcgtaacaaggtagccgtaccggaaggtgtggctggatcacctccttaatagggag

SEQ ID NO: 3093 - DNA, 1487 bp, Cyanothece sp. PCC 7425
  ref <308>: DATABASE ACCESSION NUMBER: NCBI ACCESSION: NC_011884.1
  ref <309>: DATABASE ENTRY DATE: 2019-04-01
  ref <313>: RELEVANT RESIDUES IN SEQ ID NO: (1)..(1487)
aacatggagagtttgatcctggctcaggatgaacgctggcggtatgcttaacacatgcaagtcgaacgggcccttcggggctagtggcggacgggtgagtaacgcgtgagaatctgccttcaggtcggggataacagcgggaaactgctgctaataccggatgtgccgagaggtgaaagatttattgcctgaagatgagctcgcgtctgattagctagttggtggggtaagagcctaccaaggcgacgatcagtagctggtctgagaggatgatcagccacactggaactgagacacggtccagactcctacgggaggcagcagtggggaattttccgcaatgggcgaaagcctgacggagcaataccgcgtgcgggatgaaggcccttgggtcgtaaaccgcttttctcagggaagaagtactgacggtacctgaggaacaagcctcggctaactccgtgccagcagccgcggtaagacggaggaggcaagcgttatccggaattattgggcgtaaagcgtccgcaggtggcttttcaagtctgttgttaaaacccagggcttaactctggagcagcaatggaaactgaggagctagagtgcggtaggggcagagggaattcccggtgtagcggtgaaatgcgtagatatcgggaagaacaccagtggcgaaagcgctctgctgggccgcaactgacactcatggacgaaagctaggggagcgaaagggattagatacccctgtagtcctagccgtaaacgatggagactaggtgttgtccgtatcgacccgggcagtgccgtagccaacgcgttaagtctcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatccttgtgaaagcagggagtgccttcgggagcgcgaacacaggtggtgcatggctgtcgtcagctcgtgtcgtgagatgttgggttaagtcccgcaacgagcgcaaccctcgttcttagttgccagcattcagttgggcactctagggagactgccggtgacaaaccggaggaaggtggggatgacgtcaagtcatcatgccccttacgtcctgggctacacacgtactacaatgctgtggacaaagagctgccaactcgcgagagtgagctaatctcataaaccacggctcagttcagattgcaggctgcaactcgcctgcatgaaggcggaatcgctagtaatcgcaggtcagcatactgcggtgaatacgttcccgggccttgtacacaccgcccgtcacaccatgggagctggccacgcccgaagtcgttactctaaccgtaaggaggaggatgccgaaggcagggctagtgactggggtgaagtcgtaacaaggtagccgtaccggaaggtgtggctggatcacctcctttt

SEQ ID NO: 3094 - DNA, 1491 bp, Cyanothece sp. PCC 7822
  ref <308>: DATABASE ACCESSION NUMBER: NCBI ACCESSION: NC_014501.1
  ref <309>: DATABASE ENTRY DATE: 2019-04-01
  ref <313>: RELEVANT RESIDUES IN SEQ ID NO: (1)..(1491)
catggagagtttgatcctggctcaggatgaacgctggcggcgtgcctaacacatgcaagtcgaacggggtagcaatacctagtggcggacgggtgagtaacgcgtgagaatctgccttgaggatggggataacagtgggaaaccaatgctaatacccaataggctgagaagtgaaagatttatcgcctgaagaggagctcgcgtctgattagctagttggtggggtaagagcctaccaaggcgacgatcagtagctggtctgagaggatgagcagccacactgggactgagacacggcccagactcctacgggaggcagcagtggggaattttccgcaatgggcgaaagcctgacggagcaacgccgcgtgagggaggaaggcctttgggttgtaaacctcttttcttagggaagaagcaagtgacggtacttaaggaatcagcatcggctaactccgtgccagcagccgcggtaatacggaggatgcaagcgttatccggaattattgggcgtaaagcgtccgcaggtggaatttcaagtcggctgtcaaagcccgtagcttaactacggtcaggcagtggaaactgaaagactagaggccggtaggggtagcaggaattcccagtgtagcggtgaaatgcgtagagattgggaagaacatcggtggcgaaagcgtgctactgggccggacctgacactgagggacgaaagctaggggagcgaaagggattagatacccctgtagtcctagccgtaaacgatggagactaggcgtagcttgtatcgacccgagctgtgccgaagctaacgcgttaagtctcccgcctggggagtacgcacgcaagtgtgaaactcaaaggaattgacgggggcccgcacaagcggtggagtatgtggtttaattcgatgcaacgcgaagaaccttaccagggcttgacatctgtagaacctaggggaaactctggggtgccttcgggagctacaagacaggtggtgcatggctgtcgtcagctcgtgtcgtgagatgttgggttaagtcccgcaacgagcgcaaccctcgttcttagttgccagcattaagttgggcactctaggaagactgccggtgacaaaccggaggaaggtggggatgacgtcaagtcagcatgccccttacgtcctgggcgacacacgtactacaatggtcgggacaaagggcagcaaactcgcgagagtaagcgaatctcatcaaacccggcctcagttcagattgcaggctgcaactcgcctgcatgaaggaggaatcgctagtaatcgccggtcagcatacggcggtgaattcgttcccgggccttgtacacaccgcccgtcacaccatgggagctggccacgcccgaagtcgttaccctaaccccttgtgggagggggatgccgaaggcagggctagtgactggggtgaagtcgtaacaaggtagccgtaccggaaggtgtggctggatcacctccttaaa

SEQ ID NO: 3095 - DNA, 1489 bp, Cyanothece sp. PCC 8801
  ref <308>: DATABASE ACCESSION NUMBER: NCBI ACCESSION: NC_011726.1
  ref <309>: DATABASE ENTRY DATE: 2019-04-01
  ref <313>: RELEVANT RESIDUES IN SEQ ID NO: (1)..(1489)
atggagagtttgatcctggctcaggatgaacgctggcggtatgcctaacacatgcaagtcgaacgggctcttcggagctagtggcggacgggtgagtaacgcgtgagaatctgcctcttggttggggacaacagttggaaacgactgctaatacccaatgtgccgtaaggtgaaagatttattgccaagagaggagctcgcgtctgattagctagttggcggggtaaaggcccaccaaggcatcgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcttttcttagggaagaagcaagtgacggtacctaaggaataagcatcggctaactccgtgccagcagccgcggtaatacggaggatgcaagcgttatccggaattattgggcgtaaagcgtccgtaggtggtttttcaagtctgctgtcaaagaccgtggcttaaccacggaaaggcagtggaaactgagagactagagttcggtaggggtagcgggaattcccagtgtagcggtgaaatgcgtagatattgggaagaacatcggtggcgaaggcgcgctactggaccgaaactgacactcagaggacgaaagctaggggagcgaaagggattagatacccctgtagtcctagctgtaaacgatggaaactaggtgtggcttgtatcgacccgagccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccaggacttgacatgtcgcgaatcttgatgaaagttgagagtgccttcgggagcgcgaacacaggtggtgcatggctgtcgtcagctcgtgtcgtgagatgttgggttaagtcccgcaacgagcgcaaccctcgttcttagttgccagcattaagttgggcactctagggagactgccggtgacaaaccggaggaaggtgaggatgacgtcaagtcagcatgccccttacgtcctgggcgacacacgtactacaatggttgggacaaagggcagcaaacccgcgagggggagcgaatctcatcaaacccagcctcagttcagattgcaggctgcaactcgcctgcatgaaggaggaatcgctagtaatcgcaggtcagcatactgcggtgaattcgttcccgggccttgtacacaccgcccgtcacaccatggaagctggccacacccgaagtcgttaccctaacccgcaagggagggggatgccgaaggtagggctagtgactggggtgaagtcgtaacaaggtagccgtaccggaaggtgtggctggatcacctcctttt

SEQ ID NO: 3096 - DNA, 1489 bp, Cyanothece sp. PCC 8802; identical to SEQ ID NO: 3095
  ref <308>: DATABASE ACCESSION NUMBER: NCBI ACCESSION: NC_013161.1
  ref <309>: DATABASE ENTRY DATE: 2019-04-01
  ref <313>: RELEVANT RESIDUES IN SEQ ID NO: (1)..(1489)

SEQ ID NO: 3097 - DNA, 1450 bp, Cyclobacteriaceae bacterium YHN15
  ref <308>: DATABASE ACCESSION NUMBER: NCBI ACCESSION: NZ_RKQB01000019.1
  ref <309>: DATABASE ENTRY DATE: 2019-04-01
  ref <313>: RELEVANT RESIDUES IN SEQ ID NO: (1)..(1450)
tctttcgggattgttgagagtggcgcacgggtgcgtaacgcgtatgcaacctggctcatagagggggatagcccggggaaacccggattaataccccatggtattgtttcacggcatcgtgggatgattaaagctttcgggcgttatgagatgggcatgcgtaggattagctagttggcggggtaacggcccaccaaggcgacgatccttaggggttctgagaggaaggtcccccacactggcactgagatacgggccagactcctacgggaggcagcagtagggaatattgggcaatggccggaaggctgacccagccatgccgcgtgcaggaagaaggcgttatgcgttgtaaactgcttttatacgggaagaaaaagtccatgcgtggaaaattgccggtaccgtatgaataagcaccggctaactccgtgccagcagccgcggtaatacggagggtgcgagcgttgtccggatttattgggtttaaagggtgcgtaggcggccttataagtcagcggtgaaatacccaggctcaacctggggggtgccgttgatactgtatggcttgagtacgttccgtgtacatggaatttatggtgtagcggtgaaatgcatagataccataaggaacaccgatagcgaaggcattgtacaggggcgtaactgacgctgaggcacgaaagcgtgggtagcgaacaggattagataccctggtagtccacgccgtaaacgatgatcactcgctgtttgggatttattttcaagcggccaagcgaaagcgttaagtgatccacctggggagtacgccggcaacggtgaaactcaaaggaattgacgggggtccgcacaagcggtggagcatgtggtttaattcgatgatacgcgaggaaccttacctgggctagaatgtgaaggaatgatttagagatagatcagtcagcaatgacctgaaacaaggtgctgcatggctgtcgtcagctcgtgccgtgaggtgttgggttaagtcccgcaacgagcgcaacccctgttatcagttgccaacgggtagagccggggactctgataagactgcctgcgcaagcagagaggaaggaggggacgacgtcaagtcatcatggcccttacgcccagggcgacacacgtgctacaatggcgcatacagcgggtagctacccggcaacgggatgccaacctctaaaagtgcgtctcagttcggatcggggtctgcaacccgaccccgtgaagctggaatcgctagtaatcgcgcatcagccatggcgcggtgaatacgttcccggaccttgtacacaccgcccgtcaagccatggaagtcgggtagacctgaaggcggtaaccgcgaggagccgttaagggtagaaccggtaactggggctaagtcgtaacaaggtagccgtaccggaaggtgcggctggaacacctcctttct

SEQ ID NO: 3098 - DNA, 1529 bp, Cyclobacterium amurskyense
  ref <308>: DATABASE ACCESSION NUMBER: NCBI ACCESSION: NZ_CP012040.1
  ref <309>: DATABASE ENTRY DATE: 2019-04-01
  ref <313>: RELEVANT RESIDUES IN SEQ ID NO: (1)..(1529)
tttacaatggagagtttgatcctggctcaggatgaacgctagcggcaggcctaatacatgcaagtcgtacgggatttcatctttcgggatgaatgagagtggcgcacgggtgcgtaacgcgtatgcaacctacctgttacagggagatagcccggggaaactcggattaatatcccatagtattattttactgcatggtagaatgattaaagccttcgggtggtaacagacgggcatgcgtaggattagctagttggtgaggtaacggcccaccaaggcgacgatccttaggggttctgagaggaaggtcccccacactggcactgagatacgggccagactcctacgggaggcagcagtagggaatattggtcaatgggcgagagcctgaaccagccatgccgcgtgcaggaagacggcgttctgcgttgtaaactgcttttatctgggaagaaaaagcccttgcgagggaaattgccggtaccagaggaataagcaccggctaactccgtgccagcagccgcggtaatacggagggtgcaagcgttgtccggatttattgggtttaaagggtgcgtaggcggctgattaagtcagcggtgaaagttttcggctcaaccgagagactgccgttgatactggtcagcttgagttatggaggggtacatggaatttatggtgtagcggtgaaatgcatagataccataaggaacaccgatagcgaaggcattgtactggccataaactgacgctgaggcacgaaagcgtgggtagcgaacaggattagataccctggtagtccacgccgtaaacgatgatcactcgctttaaagtacgtagtactgtgaggccaagcgaaagcgttaagtgatccacctggggagtacggtcgcaagattgaaactcaaaggaattgacgggggtccgcacaagcggtggagcatgtggtttaattcgatgatacgcgaggaaccttacccgggctagaatgtgaaggaatgatacagagatgtgtcagtcagcaatgacctgaaacaaggtgctgcatggctgtcgtcagctcgtgccgtgaggtgttgggttaagtcccgcaacgagcgcaacccctgttgtcagttgccatcaggtaatgctggggactctgacaagactgcccgcgcaagcggagaggaaggaggggacgacgtcaagtcatcatggcccttacgcccggggcgacacacgtgctacaatggcgcatacagcgggtagcgacacggcaacgtgaagccaacctctaaaagtgcgtctcagttcggatcggggcctgcaacccggccccgtgaagctggaatcgctagtaatcgcgcatcagccacggcgcggtgaatacgttcccggaccttgtacacaccgcccgtcaagccatggaagtcgggtagacctgaagacggtaaccgcaaggagccgtttagggtagaaccggtaactggggctaagtcgtaacaaggtagccgtaccggaaggtgcggctggaacacctcctttct

SEQ ID NO: 3099 - DNA, 1056 bp, Cyclobacterium lianum
  ref <308>: DATABASE ACCESSION NUMBER: NCBI ACCESSION: NZ_FRCY01000031.1
  ref <309>: DATABASE ENTRY DATE: 2019-04-01
  ref <313>: RELEVANT RESIDUES IN SEQ ID NO: (1)..(1056)
attgccggtaccgtatgaataagcaccggctaactccgtgccagcagccgcggtaatacggagggtgcgagcgttgtccggatttattgggtttaaagggtgcgtaggcggccgaataagtcagcggtgaaagtttccggctcaaccgggagactgccgttgatactgtttggcttgagtaatggaggggtacatggaatttatggtgtagcggtgaaatgcatagataccataaggaacaccgatagcgaaggcattgtaccggccatttactgacgctgaggcacgaaagcgtgggtagcgaacaggattagataccctggtagtccacgccgtaaacgatgatcactcgctgtagactgcgtagcagtttgtggccaagcgaaagcgttaagtgatccacctggggagtacgccggcaacggtgaaactcaaaggaattgacgggggtccgcacaagcggtggagcatgtggtttaattcgatgatacgcgaggaaccttacccgggctagaatgtgagtgcatgtatcagagatgatacagtccgcaaggacacaaaacaaggtgctgcatggctgtcgtcagctcgtgccgtgaggtgttgggttaagtcccgcaacgagcgcaacccctgttattagttgccatcaggtaaagctggggactctaataagactgcccgcgcaagcggagaggaaggaggggacgacgtcaagtcatcatggcccttacgcccggggcgacacacgtgctacaatggcgcatacagcgggtagcgacacggcaacgtgaagccaacctctaaaagtgcgtctcagttcggatcggggcctgcaacccggccccgtgaagctggaatcgctagtaatcgcgcatcagccacggcgcggtgaatacgttcccggaccttgtacacaccgcccgtcaagccatggaagtcgggtagacctgaagccggtaaccgcaaggagccgtttagggtagaaccggtaactggggctaagtcgtaacaaggtagccgtaccggaaggtgcggctggaacacctcctttct

SEQ ID NO: 3100 - DNA, 1527 bp, Cyclobacterium marinum
  ref <308>: DATABASE ACCESSION NUMBER: NCBI ACCESSION: NC_015914.1
  ref <309>: DATABASE ENTRY DATE: 2019-04-01
  ref <313>: RELEVANT RESIDUES IN SEQ ID NO: (1)..(1527)
tttacaatggagagtttgatcctggctcaggatgaacgctagcggcaggcctaatacatgcaagtcgtacgggatttcatctttcgggatgaatgagagtggcgcacgggtgcgtaacgcgtatgcaacctacctgttacagggagatagcccggggaaactcggattaatattccatagtatataatcgttgcatggtgattatattaaagccttcgggtggtaacagatgggcatgcgtaggattagctagttggcgaggtaacggctcaccaaggcgacgatccttaggggttctgagaggaaggtcccccacactggcactgagatacgggccagactcctacgggaggcagcagtagggaatattggtcaatgggcgagagcctgaaccagccatgccgcgtgcaggaagacggcgttctgcgttgtaaactgcttttatctgggaagaaaaagcccttgcgagggaaattgccggtaccagaagaataagcaccggctaactccgtgccagcagccgcggtaatacggagggtgcaagcgttgtccggatttattgggtttaaagggtgcgtaggcggctgattaagtcagcggtgaaagttctcggctcaaccgagagactgccgttgatactggttagcttgagttatggaggggtacatggaatttatggtgtagcggtgaaatgcatagataccataaggaacaccgatagcgaaggcattgtactggccataaactgacgctgaggcacgaaagcgtgggtagcgaacaggattagataccctggtagtccacgccgtaaacgatgatcactcgctttacattacgtagtaatttgaggccaagcgaaagcgttaagtgatccacctggggagtacgccggcaacggtgaaactcaaaggaattgacgggggtccgcacaagcggtggagcatgtggtttaattcgatgatacgcgaggaaccttacccgggctagaatgtgaaggaatgatacagagatgtgtcagtcagcaatgacctgaaacaaggtgctgcatggctgtcgtcagctcgtgccgtgaggtgttgggttaagtcccgcaacgagcgcaacccctgttgtcagttgccatcaagtaatgttggggactctgacaagactgcccgcgcaagcggagaggaaggaggggacgacgtcaagtcatcatggcccttacgcccggggcgacacacgtgctacaatggcgcatacagcgggtagcgacacggcaacgtgaagccaacctctaaaagtgcgtctcagttcggatcggggtctgcaacccgaccccgtgaagctggaatcgctagtaatcgcgcatcagccatggcgcggtgaatacgttcccggaccttgtacacaccgcccgtcaagccatggaagtcgggtagacctgaagacggtaaccgcaaggagccgtttagggtagaaccggtaactggggctaagtcgtaacaaggtagccgtaccggaaggtgcggctggaacacctccttt

SEQ ID NO: 3101 - DNA, 1541 bp, Cycloclasticus sp. PY97N
  ref <308>: DATABASE ACCESSION NUMBER: NCBI ACCESSION: NZ_CP023664.1
  ref <309>: DATABASE ENTRY DATE: 2019-04-01
  ref <313>: RELEVANT RESIDUES IN SEQ ID NO: (1)..(1541)
taaactgaagagtttgatcatggctcagattgaacgctggcggcatgcctaacacatgcaagtcgaacggaaacgatgctagcttgctagcaggcgtcgagtggcggacgggtgagtaatgcataggaatctacctaatagtgggggacaacctggtgaaaaccaggctaataccgcataatccctacggggcaaagcaggggaccttcgggccttgcgctaatagatgagcctatgtcggattagctagttggtgaggtaatggctcaccaaggcaacgatccgtagctggtttgagaggatgatcagccacactgggactgagacacggcccagactcctacgggaggcagcagtggggaatattgcacaatggaggaaactctgatgcagcaatgccgcgtgtgtgaagaaggccttagggttgtaaagcactttcagtagggaggaaaagtttaaggttaataaccttaggccctgacgttacctacagaagaagcaccggctaactccgtgccagcagccgcggtaatacggagggtgcaagcgttaatcggaattactgggcgtaaagcgcgcgtaggcggttaaacaagtcagatgtgaaagccccgggctcaacctgggaactgcatttgaaactgtttagctagagtgtggtagaggagagtggaatttcaggtgtagcggtgaaatgcgtagatatctgaaggaacaccagtggcgaaggcggctctctggaccaacactgacgctgaggtgcgaaagcgtgggtagcaaacgggattagataccccggtagtccacgccgtaaacgatgtcaactaactgttgggcgggtttccgcttagtggtgcagctaacgcaataagttgaccgcctggggagtacggccgcaaggctaaaactcaaatgaattgacgggggcccgcacaagcggtggagcatgtggtttaattcgatgcaacgcgaagaaccttacctacccttgacatacagagaactttctagagatagattggtgccttcgggaactctgatacaggtgctgcatggctgtcgtcagctcgtgtcgtgagatgttgggttaagtcccgtaacgagcgcaacccttatccttagttgctaccatttagttgggcactctaaggagactgccggtgataaaccggaggaaggtggggacgacgtcaagtcatcatggcccttatgggtagggctacacacgtgctacaatggccggtacagagggccgcaaactcgcgagagtaagctaatcccttaaagccggtcctagtccggattgcagtctgcaactcgactgcatgaagctggaatcgctagtaatcgcggatcagaatgccgcggtgaattcgttcccgggccttgtacacaccgcccgtcacaccatgggagtgggttgcaaaagaagtgggtaggctaaccttcgggaggccgctcaccactttgtgattcatgactggggtgaagtcgtaacaaggtagccctaggggaacctggggctggatcacctcctttct

SEQ ID NO: 3102 - DNA, 1490 bp, Cylindrospermum stagnale
  ref <308>: DATABASE ACCESSION NUMBER: NCBI ACCESSION: NC_019757.1
  ref <309>: DATABASE ENTRY DATE: 2019-04-01
  ref <313>: RELEVANT RESIDUES IN SEQ ID NO: (1)..(1490)
aaaacggagagtttgatcctggctcaggatgaacgctggcggtatgcttaacacatgcaagtcgaacggtctcttcggagatagtggcggacgggtgagtaacgcgtgagaatctgccttcaggtctgggacaaccactggaaacggtggctaataccggatgtgccgagaggtgaaaggttaactgcctgaagaggagctcgcgtctgattagctagttggtggggtaaaagcctaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaataaaaaaatgaaggtacctgaggaataagcatcggctaactccgtgccagcagccgcggtaatacggaggatgcaagcgttatccggaatgattgggcgtaaagcgtccgcaggtggctatgtaagtctgctgttaaagagcaaggctcaaccttgtaaaggcagtggaaactacatagctagagtgcgttcggggcagagggaattcctggtgtagcggtgaaatgcgtagatatcaggaagaacaccggtggcgaaagcgctctgctaggccgcaactgacactgagggacgaaagctaggggagcgaatgggattagataccccagtagtcctagccgtaaacgatggatactaggcgttgcttgtatcgacccgagcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaaggcttgacatgtcgcgaatctccttgaaaggggagagtgccttcgggagcgcgaacacaggtggtgcatggctgtcgtcagctcgtgtcgtgagatgttgggttaagtcccgcaacgagcgcaaccctcgtttttagttgccagcacttcgggtgggcactctagagagactgccggtgacaaaccggaggaaggtggggatgacgtcaagtcagcatgccccttacgccttgggctacacacgtactacaatgctacggacagagggcagcaagctagcgatagcaagctaatcccggaaaccgtagctcagttcagatcgcaggctgcaactcgcctgcgtgaaggaggaatcgctagtaattgcaggtcagcatactgcagtgaattcgttcccgggccttgtacacaccgcccgtcacaccatggaggctggtcacgcccgaagtcgttaccccaacccttgtggagggggatgcctaaggcaggactggtgactggggtgaagtcgtaacaaggtagccgtaccggaaggtgtggctggatcacctcctttt

SEQ ID NO: 3103 - DNA, 1264 bp, Cysteiniphilum litorale
  ref <308>: DATABASE ACCESSION NUMBER: NCBI ACCESSION: NZ_QLIQ01000128.1
  ref <309>: DATABASE ENTRY DATE: 2019-04-01
  ref <313>: RELEVANT RESIDUES IN SEQ ID NO: (1)..(1264)
accttcgggtcaaaggttgcttaggcagtcgctgtacgatgagcctgcgttggattagctagttggtgaggtaaaggctcaccaaggcgatgatccatagctgttctgagaggaagatcagccacactgggactgagacacggcccagactcctacgggaggcagcagtggggaatattggacaatgggggcaaccctgatccagcaataccacgtgtgtgaagaaggccttagggttgtaaagcactttagttagggaggaaggttatcaggttaagagctagataatttgacgttacctaaagaataagcaccggctaactccgtgccagcagccgcggtaatacggagggtgcgagcgttaatcggaattactgggcgtaaagggttcgtaggtggttagataagtcagatgtgaaagccctgggctcaacctgggaactgcatttgatactgtttaactagagtttactagaggattggggaatttccggtgtagcggtgaaatgcgtagagatcggaaggaacatcaatggcgaaggcaacaatctggggttaaactgacactgagggacgaaagcgtgggtagcaaacaggattagataccctggtagtccacgctgtaaacgatgagtactagctgttgggtctggtgtaaaagacttagtggcgcagctaacgcgataagtactccgcctggggactacggccgcaaggttaaaactcaaaggaattgacggggacccgcacaagcggtggagcatgtggtttaattcgatgcaacgcgaagaaccttacctgcccttgacatccatagaagatctgagagattggattgtgccttcgggaactatgagacaggtgctgcatggctgtcgtcagctcgtgttgtgaaatgttgggttaagtcccgcaacgagcgcaacccttatttttagttgccatcattaagttgggcactctagagagactgccgctgataaggcggaggaaggtggggacgacgtcaagtcatcatggcccttacgggcagggctacacacgtgctacaatgggcattacagagggaagcgaagctgcgaggtggagcgaaactcagaaaggtgttcgtagtccggattgctctctgcaactcgagagcatgaagtcggaatcgctagtaatcgcggatcagaatgccgcggtgaatacgttcccgggtcttgtacacaccgcccgtcacaccatgggagtgggttgcaaaagaagtagatagtctaaccgc

SEQ ID NO: 3104 - DNA, 1526 bp, Cytophaga aurantiaca
  ref <308>: DATABASE ACCESSION NUMBER: NCBI ACCESSION: NZ_KB903660.1
  ref <309>: DATABASE ENTRY DATE: 2019-04-01
  ref <313>: RELEVANT RESIDUES IN SEQ ID NO: (1)..(1526)
tttacaatggagagtttgatcctggctcaggatgaacgctagcggcaggcctaatacatgcaagtcgaggggcagcggggtagcaatactgccggcgaccggcgcacgggtgcgtaacacgtatgcaacctaccttaaactgggggatagcccggggaaactcggattaataccccataacacgtggatgtctcatgacaattacgttaaagatttatcggtttaagctgggcatgcgttcgattagctagttggtgaggtaatggctcaccaaggctacgatcgatagggggtctgagaggatgatcccccacactggtactgagatacggaccagactcctacgggaggcagcagtagggaatattggtcaatggaggcaactctgaaccagccatgccgcgtgtaggaagaaggcgttctgcgttgtaaactacttttgattgggaacaaatgactcttgcgagagtagctgagtgtaccaatagaataagccacggctaactacgtgccagcagccgcggtaatacgtaggtggcaagcgttgtccggatttattgggtttaaagggtgcgtaggcggcttgataagtcagtggtgaaagccgatcgcttaacgatcgaactgccattgatactgtcgggcttgagtatagttgaggtaggcggaattgacagtgtagcggtgaaatgcatagatattgtcaagaacaccaattgcgaaggcagcttactaaagtataactgacgctgaggcacgaaagtgcggggatcaaacaggattagataccctggtagtccgcacagtaaacgatgatcactcgctgtgtgcgataaacagtacgcggccaagcgaaagcgataagtgatccacctggggagtacgcccgcaagggtgaaactcaaaggaattgacgggggtccgcacaagcggtggagcatgtggtttaattcgatgatacgcgaggaaccttacctaggctagaatgtgaaggaatgtatcagaaatggtgcagtcagcaatgacctgaaacaaggtgctgcatggctgtcgtcagctcgtgccgtgaggtgttgggttaagtcccgcaacgagcgcaacccctatctttagttgccagcgggttaagccggggactctagagagactgcctgtgtaaacagagaggaaggaggggacgacgtcaagtcatcatggcccttacgcctagggctacacacgtgctacaatggcgcatacagagtgttgcaagctagtgatagcaagccaatcacaaaaagtgcgtctcagttcggattgaagtctgcaactcgacttcatgaagctggaatcgctagtaatcgcgtatcagcaatgacgcggtgaatacgttcccggaccttgtacacaccgcccgtcaagccatgaaagtctggtggacctgaaggccgtaaccgcaaggagcggctcagggtaaaacaggtaattagggctaagtcgtaacaaggtagccgtaccggaaggtgcggctggaacacctcctttct

SEQ ID NO: 3105 - DNA, 1526 bp, Cytophaga hutchinsonii
  ref <308>: DATABASE ACCESSION NUMBER: NCBI ACCESSION: NZ_FPJX01000031.1
  ref <309>: DATABASE ENTRY DATE: 2019-04-01
  ref <313>: RELEVANT RESIDUES IN SEQ ID NO: (1)..(1526)
tttacaatggagagtttgatcctggctcaggatgaacgctagcggcaggcctaatacatgcaagtcgaggggcagcggggtagcaatactgccggcgaccggcgcacgggtgcgtaacacgtatgcaacctaccttaaactgggagatagcccggggaaactcggattaataccccataacacatttgtgtctcatgacatgattgttaaagatttatcggtttaagatgggcatgcgttcgattagctagttggtgaggtaatggctcaccaaggctacgatcgatagggggtctgagaggatgatcccccacactggtactgagatacggaccagactcctacgggaggcagcagtagggaatattggtcaatggaggcaactctgaaccagccatgccgcgtgtaggaagaaggcgttctgcgttgtaaactacttttgattgggaacaaatgactcttgcgagagtagctgagtgtaccaatagaataagccacggctaactacgtgccagcagccgcggtaatacgtaggtggcaagcgttgtccggatttattgggtttaaagggtgcgtaggcggcttaataagtcagtggtgaaagccgatcgcttaacgatcgaactgccattgatactgctaggcttgagtatagatgaggtaggcggaattgacagtgtagcggtgaaatgcatagatattgtcaagaacaccaattgcgaaggcagcttactaagttataactgacgctgaggcacgaaagtgcggggatcaaacaggattagataccctggtagtccgcaccgtaaacgatgatcactcgctgtgtgcgataaacagtacgcggccaagcgaaagcgataagtgatccacctggggagtacgcccgcaagggtgaaactcaaaggaattgacgggggtccgcacaagcggtggagcatgtggtttaattcgatgatacgcgaggaaccttacctaggctagaatgtgaaggaatgtatcagaaatggtgcagtcagcaatgacctgaaacaaggtgctgcatggctgtcgtcagctcgtgccgtgaggtgttgggttaagtcccgcaacgagcgcaacccctatctttagttgccagcgagttatgtcggggactctagagagactgcctgtgtaaacagagaggaaggaggggacgacgtcaagtcatcatggcccttacgcctagggctacacacgtgctacaatggcgcatacagagtgttgcaagctagtgatagcaagccaatcacaaaaagtgcgtctcagttcggattgaagtctgcaactcgacttcatgaagctggaatcgctagtaatcgcgtatcagcaatgacgcggtgaatacgttcccggaccttgtacacaccgcccgtcaagccatgaaagtctggtggacctgaaggccgtaaccgcaaggagcggctcagggtaaaacaggtaattagggctaagtcgtaacaaggtagccgtaccggaaggtgcggctggaacacctcctttct

SEQ ID NO: 3106 - DNA, 1510 bp, Cytophagaceae bacterium CAR-16
  ref <308>: DATABASE ACCESSION NUMBER: NCBI ACCESSION: NZ_SDHY01000016.1
  ref <309>: DATABASE ENTRY DATE: 2019-04-01
  ref <313>: RELEVANT RESIDUES IN SEQ ID NO: (1)..(1510)
tttacaatggagagtttgatcctggctcaggatgaacgctagcggcaggcctaatacatgcaagtcgaacggtgtagcaatacacagtggcgcacgggtgcgtaacacgtatgcaacctaccttacattgggggatagcctttcgaaagggagattaataccgcataagacagtaactaggcatctagtagctgttaaagatttatcgatgtaagctgggcatgcgtccaattagttagttggtgaggtaacggctcaccaagacgatgattggtaggggaactgagaggtcaatcccccacactggcactgagatacgggccagactcctacgggaggcagcagtagggaatattgggcaatgggcgcaagcctgacccagccatgccgcgtgcaggaagaaggcgttatgcgttgtaaactgcttttatacaggaagaaacgacccttgcgaggggcattgacggtactgtatgaataagcaccggctaactccgtgccagcagccgcggtaatacggagggtgcaagcgttgtccggatttattgggtttaaagggtgcgcaggtggtttattaagtcagtggtgaaagacggtcgctcaacgattgcagtgccattgatactggtagacttgagtaaagtagaggtgggcggaattgatagtgtagcggtgaaatgcatagatattatcaagaactccaattgcgtaggcagctcactaggcttttactgacactcatgcacgaaagtgtgggtatcaaacaggattagataccctggtagtccacactgtaaacgatgataactaggtgtcggcttttcggagtcggtgccacagcgaaagcgttaagttatccacctggggagtacgccggcaacggtgaaactcaaaggaattgacgggggtccgcacaagcggtggagcatgtggtttaattcgatgatacgcgaggaaccttacctaggctagaatgtgaaggaatgatacagaaatggatcagtcagcaatgacctgaaacaaggtgctgcatggctgtcgtcagctcgtgccgtgaggtgttgggttaagtcccgcaacgagcgcaacccctgcatttagttgccagcacgtaaaggtggggactctaaatggactgcctacgcaagtagagaggaaggaggggacgacgtcaagtcatcatggcccttacgcctagggctacacacgtgctacaatgggcggtacagagggtagctacctggtaacaggatgccaatctcgaaagccgctcacagttcggattggggtctgcaactcgaccctatgaagctggaatcgctagtaatcgcgtatcagcaatgacgcggtgaatacgttcccggaccttgtacacaccgcccgtcaagccatgaaagtctggtagacctgaagctggcctttaaaccgccagttagggtagaacaggtaattggggctaagtcgtaacaaggtagccgtaccggaaggtgtggctggaacacctcctttc

SEQ ID NO: 3107 - DNA, 1510 bp, Cytophagaceae bacterium FSY-15
  ref <308>: DATABASE ACCESSION NUMBER: NCBI ACCESSION: NZ_SACY01000009.1
  ref <309>: DATABASE ENTRY DATE: 2019-04-01
  ref <313>: RELEVANT RESIDUES IN SEQ ID NO: (1)..(1510)
tttacaatggagagtttgatcctggctcaggatgaacgctagcggcaggcctaatacatgcaagtcgaacggtgtcttcggacatagtggcgcacgggtgcgtaacacgtatgcaacctaccttacattgggggatagcctttcgaaagggagattaataccgcataagacagtaactaggcatctagtagctgttaaagatttatcgatgtaagctgggcatgcgtccaattagttagttggtgaggtaatggctcaccaagacgatgattggtaggggaactgagaggtcaatcccccacactggcactgagatacgggccagactcctacgggaggcagcagtagggaatattgggcaatgggcgcaagcctgacccagccatgccgcgtgcaggaagaaggcgttctgcgttgtaaactgcttttatataggaagaaacggcccttgcgagggacattgacggtactatatgaataagcaccggctaactccgtgccagcagccgcggtaatacggagggtgcaagcgttgtccggatttattgggtttaaagggtgcgcaggtggtttattaagtcagtggtgaaagacggtcgctcaacgattgcagtgccattgatactggtagacttgagtaaattagaggtgggcggaattgatagtgtagcggtgaaatgcatagatattatcaagaactccgattgcgaaggcagctcacttggcttttactgacactcatgcacgaaagtgtgggtatcaaacaggattagataccctggtagtccacactgtaaacgatgataactaggtgttggccgaatctggtcagtgccacagcgaaagcgttaagttatccacctggggagtacgccggcaacggtgaaactcaaaggaattgacgggggtccgcacaagcggtggagcatgtggtttaattcgatgatacgcgaggaaccttacctaggctagaatgtgaaggaatgatacagaaatggatcagtcagcaatgacctgaaacaaggtgctgcatggctgtcgtcagctcgtgccgtgaggtgttgggttaagtcccgcaacgagcgcaacccctgcatttagttgccagcacgtaatggtgggaactctaaatggactgcctacgcaagtagagaggaaggaggggacgacgtcaagtcatcatggcccttacgcctagggctacacacgtgctacaatgggcggtacagagggtagctacctggtaacaggatgccaatctctaaagccgttcacagttcggattggggtctgcaactcgaccctatgaagctggaatcgctagtaatcgcgtatcagcaatgacgcggtgaatacgttcccggaccttgtacacaccgcccgtcaagccatgaaagtctggtagacctgaagctggcctttaaaccgccagttagggtagaacaggtaattggggctaagtcgtaacaaggtagccgtaccggaaggtgtggctggaacacctcctttc

SEQ ID NO: 3108 - DNA, 1527 bp, Cytophagaceae bacterium Ys
  ref <308>: DATABASE ACCESSION NUMBER: NCBI ACCESSION: NZ_BHXQ01000014.1
  ref <309>: DATABASE ENTRY DATE: 2019-04-01
  ref <313>: RELEVANT RESIDUES IN SEQ ID NO: (1)..(1527)
ttacaatggagagtttgatcctggctcaggatgaacgctagcggcaggcttaatacatgcaagacgaacggtaagctttgtagcaatacaaatcctagagtgtcgtaagggtgcgtaacacgtatgcaatctgccctgtacaggagtatagctccccgaaaggggaattaaccctccataggatcgtagggtggcatcacctagcgattaaaactgaggtggtacaggatgagcatgcgtctgattagctagttggcggggtaacggcccaccaaggcgatgatcagtaggggaactgagaggttgatcccccacactggcactgagatacgggccagactcctacgggaggcagcagtagggaatattggacaatgggtgagagcctgatccagccatgccgcgtgcaggatgacggccttctgggttgtaaactgcttttatctggggataaaaaggccttgcgaggcaaactgaaggtaccagatgaataagccacggctaactacgtgccagcagccgcggtaatacgtaggtggcaagcgttgtccggatttattgggtttaaagggtgcgtaggcggtttattaagtcagtggtgaaagacgatagctcaactatcgaggtgccattgatactgatgaacttgagtgcagtcgaagtaggcggaatggacggtgtagcggtgaaatgcatagatatcgtccagaacaccgatagtgaagacagcttactaggctgtaactgacgctgaggcacgaaagtgtggggatcaaacaggattagataccctggtagtccacactgtaaacgttgataactcgctgttggcgatacacagccagcggccaagcgcaagcgataagttatccacctggggagtacgccggcaacggtgaaactcaaaggaattgacgggggtccgcacaagcggtggagcatgtggtttaattcgatgatacgcgaggaaccttacctgggctagaatgcctatgattgatccagagatggatagttccgcaaggacagagtgcaaggtgctgcatggctgtcgtcagctcgtgccgtgaggtgttgggttaagtcccgcaacgagcgcaacccctattcttagttgccagcatgtcatggtggggactctaagaagactgcccgcgcaagcggagaggaaggaggggatgacgtcaagtcatcatggcccttacgcccagggctacacacgtgctacaatggcgtatacaaagtgttgccagtcagcgatgacgagccaatcacaaaaagtacgtctcagttcggattgcaggctgcaactcgcctgcatgaagttggaatcgctagtaatcgcgcatcagcaatggcgcggtgaatacgttcccggaccttgtacacaccgcccgtcaagcgatggaagttgggaggacctgaaggcagttgttgcaagacgctgtttagggttaaaccgataactggcgctaagtcgtaacaaggtagccgtaccggaaggtgcggctggaacacctcctttct

SEQ ID NO: 3109 - DNA, 1530 bp, Cytophagales bacterium B6
  ref <308>: DATABASE ACCESSION NUMBER: NCBI ACCESSION: NZ_BACV01000023.1
  ref <309>: DATABASE ENTRY DATE: 2019-04-01
  ref <313>: RELEVANT RESIDUES IN SEQ ID NO: (1)..(1530)
tacaatggagagtttgatcctggctcaggatgaacgctagcggcaggcctaatacatgcaagtcggacgggatagaggagcttgcttctcttgagagtggcgcacgggtgcgtaacacgtatgtaacctaccttagtcagggggatagcctctcgaaagagagattaagaccgcataacatattggagtggcatcgctttaatatcaaatatttataggactaagatgggcatgcgcaacattagctagttggtgtggtaacggcataccaaggcgacgatgtttaggggatctgagaggatgaccccccacactggtactgagacacggaccagactcctacgggaggcagcagtaaggaatattggtcaatggacggaagtctgaaccagccatgccgcgtgcaggaagacggccctatgggttgtaaactgcttttgcaggggaataaaccttggtatgtataccaagctgaatgtactctgagaataaggatcggctaactccgtgccagcagccgcggtaatacggaggatccgagcgttatccggatttattgggtttaaagggtgcgtaggcggctttttaagtcaggggtgaaagacggtagcttaactatcgcagtgcccttgatactgaagagcttgaatgtagttgaggtaggcggaatgtgacaagtagcggtgaaatgcatagatatgtcacagaacaccaattgcgaaggcagcttactaagctatgattgacgctgaggcacgaaagcgtggggatcaaacaggattagataccctggtagtccacgccctaaacgatgaacactcgatgttggcgatatacggtcagcgtctaagcgaaagcgttaagtgttccacctggggagtacgcccgcaagggtgaaactcaaaggaattgacgggggcccgcacaagcggaggagcatgtggtttaattcgatgatacgcgaggaaccttacccgggcttgaaagttagtgaatgaagcagagacgcttcagtccttcgggacacgaaactaggtgctgcatggctgtcgtcagctcgtgccgtgaggtgttgggttaagtcccgcaacgagcgcaacccctatgtttagttgccagcatgtaaaggtggggactctaaacagactgcctatgcaaatagagaggaaggaggggacgacgtcaagtcatcatggcccttacgtccggggctacacacgtgctacaatggatggtacagagggccgctacctggcaacaggatgccaatctcggaaagccattcacagttcggatcggggtctgcaactcgaccccgtgaagttggattcgctagtaatcgcgtatcagcaatgacgcggtgaatacgttcccgggccttgtacacaccgcccgtcaagccatggaagctggaagtgcctgaagtgcgtaaccgcaaggagcgtcctagggtaaagtcggtaactggggctaagtcgtaacaaggtagccgtaccggaaggtgtggctggaatacctcctttctggagc

SEQ ID NO: 3110 - DNA, 1490 bp, Dactylococcopsis salina
  ref <308>: DATABASE ACCESSION NUMBER: NCBI ACCESSION: NC_019780.1
  ref <309>: DATABASE ENTRY DATE: 2019-04-01
  ref <313>: RELEVANT RESIDUES IN SEQ ID NO: (1)..(1490)
aacatggagagtttgatcctggctcaggatgaacgctggcggcgtgcttaacacatgcaagtcgaacgaagtcttcggacttagtggcggacgggtgagtaacgcgtgagaatctaccttctagatggggacaaccgttggaaacgacggctaatccccaatacgccgaaaggtgaaatggttttccgctagaagaggagctcgcgtccgattagttagttggtggggtaaaagcctaccaaagcgtcgatcggtagctggtctgagaggatgagcagccacactgggactgagacacggcccagactcctacgggaggcagcagtggggaattttccgcaatgggcgaaagcctgacggagcaacgccgcgtgtgggaagaaggctcttgggctgtcaaccacttttctcagggaagaatgactgacggtacctgaggaatcagcctcggctaactccgtgccagcagccgcggtaatacggaggaggcaagcgttatccggaattattgggcgtaaagcgtccgcagggggcgcatcaagtctgctgtcaaaggtcggagcttaactccggtgtggcagtggaaacgggtgcgctagagggcgacaggggtagagggaattcccagtgtagcggtgaaatgcgtagagattgggaagaacaccggtggcgaaagcgctctactgggtcgcacctgaccctcagggacgaaagctaaggtagcgaaagggattagatacccctgtagtcttagccgtaaacgatggatactaggcgtggtttgtatcgacccaagccgtgccgaagctaacgcgttaagtatcccgcctggggagtacgcacgcaagtgtgaaactcaaaggaattgacgggggcccgcacaagcggtggaggatgtggtttaattcgatgcaacgcgaagaaccttaccagggcttgacatcccgcggatccccatgaaagtggggagtgccttcgggaacgcggagacaggtggtgcatggctgtcgtcagctcgtgtcgtgagatgttgggttaagtcccgcaacgagcgcaaccctcgtccttagttgccagcattaggttgggaactctagggagactgccggtgacaaaccggaggaaggtgaggatgacgtcaagtcagcatgccccttatgctctgggcgacacacgtcctacaatggtcgggacaaagggaagcgaactcgcaagagccagcaaatcccatcaaactcggcctcagttcagatagcaggctgcaactcgcctgcttgaaggaggaatcgctagtaatcgccggtcagaatacggcggtgaattcgttcccgggccttgtacacaccgcccgtcacaccatggaagctggccaagcccgaagtcgttaccctaacccgtgtggaggggggcgccgaaggctgggctagtgactggggtgaagtcgtaacaaggtagccgtaccggaaggtgtggctggatcacctccttaa

SEQ ID NO: 3111 - DNA, 1544 bp, Dechloromonas sp. HYN0024
  ref <308>: DATABASE ACCESSION NUMBER: NCBI ACCESSION: NZ_CP031842.1
  ref <309>: DATABASE ENTRY DATE: 2019-04-01
  ref <313>: RELEVANT RESIDUES IN SEQ ID NO: (1)..(1544)
gattgaactgaagagtttgatcctggctcagattgaacgctggcggcatgccttacacatgcaagtcgaacggcagcacggggcaacctggtggcgagtggcgaacgggtgagtaatgtatcggaacgtacctttcagtgggggataacgtagcgaaagttacgctaataccgcatattctgtgagcaggaaagcaggggatcgcaagaccttgcgctgattgagcggccgatatcagattagctagttggtgaggtaaaggctcaccaaggcgacgatctgtagcgggtctgagaggatgatccgccacactggaactgagacacggtccagactcctacgggaggcagcagtggggaattttggacaatgggcgcaagcctgatccagccatgccgcgtgagtgaagaaggccttcgggttgtaaagctctttcagccgggaagaaaacgcatgggttaataccctgtgtggatgacggtaccggaataagaagcaccggctaactacgtgccagcagccgcggtaatacgtagggtgcgagcgttaatcggaattactgggcgtaaagcgtgcgcaggcggttttgtaagacaggcgtgaaatccccgggctcaacctgggaactgcgtttgtgactgcaaggctagagtatggcagaggggggtggaattccacgtgtagcagtgaaatgcgtagagatgtggaggaacaccgatggcgaaggcagccccctgggccaatactgacgctcatgcacgaaagcgtgggtagcaaacaggattagataccctggtagtccacgccctaaacgatgtcaactaggtgttgggtgggtaaaaccatttagtaccggagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgtccaggagcctgaagagatttgggtgtgctcgaaagagaactggaacacaggtgctgcatggctgtcgtcagctcgtgtcgtgagatgttgggttaagtcccgcaacgagcgcaacccttgtcgttaattgccatcatttagttgggcactttaacgagactgccggtgacaaaccggaggaaggtggggatgacgtcaagtcctcatggcccttatgggtagggcttcacacgtcatacaatggtcggtacaaagggttgccaagccgcgaggtggagctaatcccagaaagccgatcgtagtccggatcgtaggctgcaactcgcctgcgtgaagtcggaatcgctagtaatcgtggatcagcatgtcacggtgaatacgttcccgggtcttgtacacaccgcccgtcacaccatgggagcgggttccgccagaagtaggtagcctaaccgcaaggggggcgcttaccacggcggggttcgtgactggggtgaagtcgtaacaaggtagccgtaggggaacctgcggctggatcacctcctttctag

SEQ ID NO: 3112 - DNA, 1570 bp, Deferribacter desulfuricans
  ref <308>: DATABASE ACCESSION NUMBER: NCBI ACCESSION: NC_013939.1
  ref <309>: DATABASE ENTRY DATE: 2019-04-01
  ref <313>: RELEVANT RESIDUES IN SEQ ID NO: (1)..(1570)
tttgtatggagagtttgatcctggctcaggacgaacgctggcggcgtgcctaacacatgcaagtcagggggaaagctggcttcggtcagtgagtacaccggcggacgggtgagtaacgcgtgagcaacctaccccgcagaccgggataacccatcgaaaggtgggctaatactggatgagcgcacgtgctgcatggcatgtgtgaaaaggcaggctttaagcttgcgctgcgggatgggctcgcgtcccattagctagttggtgaggtaacggctcaccaaggctacgatgggtagccggcctgagagggtggtcggccacattgggactgagacacggcccagactcctacgggaggcagcagtggggaatattgcgcaatgccggaaacggtgacgcagcgacgccgcgtgggcgaggaaggccttcgggtcgtaaagccctttcagtggggaagaaaggtgcaggcagtaactggtctgtatttgacggtacccacagaagaagccccggctaactccgtgccagcagccgcggtaatacggagggggcgagcgttgttcggagtcactgggcgtaaagcgcacgtaggcggtgcggtaagtctggggtcaaaggctacggctcaaccgtagtaaggcctcagatactatcgtgctagagtgccggagagggtagcggaattccctgtgtagcggtgaaatgcgtagatatagggaggaacaccggttgcgaaggcggctacctggccggtaactgacgctgaggtgcgagagcgtggggagcaaacaggattagataccctggtagtccacgctgtaaacgatgggcgctaggtgttggtggttagtagccatcagtgccgaagctaacgcgttaagcgccccgcctggggagtacggccgcaaggctgaaactcaaaggaattgacgggggcccgcacaagcggtggagcacgtggtttaattcgatgctaaccgaagaaccttacctgggcttgacatccccgggacctgccagagatggtggggtgcctggttttaccaggagccgggagacaggtgctgcatggctgtcgtcagctcgtgccgtgaggtgttgggttaagtcccgcaacgagcgcaacccctacccttagttgccatcggttaggccgggcactctaaggggactgccccggataacggggaggaaggtggggatgacgtcaagtcatcatggcccttatgtccagggctacacacgtgctacaatggggcgtacagagggcagcgaagccgcgaggctgagcgaatctcagaaagcgctcctcagttcggatcgcagtctgcaactcgactgcgtgaagccggaatcgctagtaatcgcaggtcagcaaaactgcggtgaatacgttcccgggccttgtacacaccgcccgtcacaccacgggagttggctatacctgaagccggtggcccaacccaggcaactgggggggagccgtccatggtatggctggcgactggggtgaagtcgtaacaaggtagccgtaccggaaggtgtggctggatcacctcctttctaagga

SEQ ID NO: 3113 - DNA, 1469 bp, Defluviimonas alba
  ref <308>: DATABASE ACCESSION NUMBER: NCBI ACCESSION: NZ_CP012661.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcggatccttcgggattagcggcggacgggtgagtaacgcgtgggaacataccctttggtacggaatagcctcgggaaactgagagtaataccgtatgtgcccttcgggggaaagatttatcgccaaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgatcgatgaaggccttagggttgtaaagatctttcagtggggaagataatgacggtacccacagaagaagccccggctaactccgtgccagcagccgcggtaatacggagggggctagcgttgttcggaattactgggcgtaaagcgcacgtaggcggattggaaagttgggggtgaaatcccagggctcaaccctggaactgccttcaaaactcccagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggtcgcaagattaaaactcaaaggaattgacggggcccgcacaagcggtggagcatgtggtttaattcgaagcaacgcgcagaaccttaccaacccttgacatgggtatcgcggctccagagatggagctttcagttcggctggataccacacaggtgctgcatggctgtcgtcagctcgtgtcgtgagatgttcggttaagtccggcaacgagcgcaacccacactcttagttgccagcattcagttgggcactctaggagaactgcgatgataagtcggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggcggtgcgccaacctcgcaagaggaggcagccgaccacggtgagctcagcgactggggtgaagtcgtaacaaggtagccgtaggggaacctgcggctggatcacctcctttctaa

SEQ ID NO: 3114 - DNA, 1469 bp, Defluviimonas aquaemixtae
  ref <308>: DATABASE ACCESSION NUMBER: NCBI ACCESSION: NZ_OMOQ01000002.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgaaccttcgggttagcggcggacgggttagtaacgcgtgggaatatgcccaaaggtacggaatagcctctggaaacggagagtaataccgtatgtgcccttcgggggaaagatttatcgcctttggattagcccgcgttggattaggtagttggtggggtaatggcctaccaagccgacgatccatagctggtttgagaggatgatcagcaacactgggactgagacacggcccagactcctacgggaggcagcagtggggaatcttagacaatgggggaaaccctgatctagccatgccgcgtggacgatgaaggccctagggttgtaaagtcctttcagctgggaagataatgacggtaccagcagaagaagccccggctaactccgtgccagcagccgcggtaatacggagggggctagcgttgttcggaattactgggcgtaaagcgcacgtaggcggactggaaagttgggggtgaaatcccagggctcaaccctggaactgcctccaaaactatcagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttccagagatggttccttcagttcggctggatcagtgacaggtgctgcatggctgtcgtcagctcgtgtcgtgagatgttcggttaagtccggcaacgagcgcaacccacacccttagttgccagcattcagttgggcactctaggggaactgccgatgataagtcggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggcggtgcgccaacctcgcaagagggggcagccgaccacggtgggctcagcgactggggtgaagtcgtaacaaggtagccgtaggggaacctgcggctggatcacctcctttctaa

SEQ ID NO: 3115 - DNA, 1471 bp, Defluviimonas denitrificans
  ref <308>: DATABASE ACCESSION NUMBER: NCBI ACCESSION: NZ_PVEP01000004.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcctaacacatgcaagtcgagcgaacccttcggggttagcggcggacgggttagtaacgcgtgggaatatgcccaaaggtacggaatagcctcgggaaactgagagtaataccgtatgtgcccttcgggggaaagatttatcgcctttggattagcccgcgttggattaggtagttggtggggtaatggcctaccaagccgacgatccatagctggtttgagaggatgatcagcaacactgggactgagacacggcccagactcctacgggaggcagcagtggggaatcttagacaatgggggaaaccctgatctagccatgccgcgtggacgatgaaggccttagggttgtaaagtcctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctttgatactggtagtctagagttcgagagaggtgagtggaactccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgatgaatgccagacgtcggcaagcatgcttgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgtgtatcgcggttccagagatggttccttcagttcggctggatacaacacaggtgctgcatggctgtcgtcagctcgtgtcgtgagatgttcggttaagtccggcaacgagcgcaacccacacttctagttgccagcattcagttgggcactctagaagaactgccgatgataagtcggaggaaggtgtggatgacgtcaagtcctcatggcccttacgggttgggctacacacgtgctacaatggcagtgacaatgggataatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggttcacccgaaggcggtgcgccaacctcgcaagagggggcagccgaccacggtgggctcagcgactggggtgaagtcgtaacaaggtagccgtaggggaacctgcggctggatcacctcctttctaa

SEQ ID NO: 3116 - DNA, 1473 bp, Defluviimonas sp. 20V17
  ref <308>: DATABASE ACCESSION NUMBER: NCBI ACCESSION: NZ_AYXI01000121.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgaacccttcggggttagcggcggacgggtgagtaacgcgtgggaatatgcccaaaggtacggaatagcctcgggaaactgggagtaataccgtatgtgcccttcgggggaaagatttatcgcctttggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcgcgtaggcggaccatcaagttgggggtgaaatcccggggctcaacctcggaactgcctccaaaactgctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcgatttccagagatggatttcttcagttcggctggataccacacaggtgctgcatggctgtcgtcagctcgtgtcgtgagatgttcggttaagtccggcaacgagcgcaacccacacccttagttgccagcattcagttgggcactctaggggaactgccgatgataagtcggaggaaggtgtggatgacgtcaagtcctcatggcccttacgggttgggctacacacgtgctacaatggcagtgacaatgggttaatccccaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaaggtggtgcgccaacctagcaatagggggcagccaaccacggtaggctcagcgactggggtgaagtcgtaacaaggtagccgtaggggaacctgcggctggatcacctcctttctaa

SEQ ID NO: 3117 - DNA, 957 bp, Defluviimonas sp. MS2-2
  ref <308>: DATABASE ACCESSION NUMBER: NCBI ACCESSION: NZ_PHSN01000005.1
  ref <309>: DATABASE ENTRY DATE: 2019-04-01
  ref <313>: RELEVANT RESIDUES IN SEQ ID NO: (1)..(957)
caacttgagagtttgatcctggctcagaacgaacgctggcggcaggcctaacacatgcaagtcgagcgagattttcggatctagcggcggacgggtgagtaacgcgtgggaatatgcccttctctacggaatagcctcgggaaactgggagtaataccgtatacgccctttgggggaaagatttatcggagaaggattagcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactattaagtgaggggtgaaatcccggggctcaacctcggaactgcctttcatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgggtatcgcgatttccag

SEQ ID NO: 3118 - DNA, 1465 bp, Defluviimonas sp. XJ4
  ref <308>: DATABASE ACCESSION NUMBER: NCBI ACCESSION: NZ_RJRZ01000032.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcctaacacatgcaagtcgagcgaaccttcgggttagcggcggacgggtgagtaacgcgtgggaacgtgcccaaaggtacggaatagccccgggaaactgggagtaataccgtatgtgcccttcgggggaaagaatttcgcctttggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggattggaaagttgggggtgaaatcccggggctcaaccccggaactgccttcaaaactcccagtctggagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggggatcgcgggaccagagatggtcctttcagttcggctggatcccacacaggtgctgcatggctgtcgtcagctcgtgtcgtgagatgttcggttaagtccggcaacgagcgcaacccacactcttagttgccagcattcagttgggcactctaggagaactgccgatgataagtcggaggaaggtgtggatgacgtcaagtcctcatggcccttacgggttgggctacacacgtgctacaatggcagtgacaatgggataatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctgcaaagggggcagctggccacggtaggctcagcgactggggtgaagtcgtaacaaggtagccgtaggggaacctgcggctggatcacctcctttcta

SEQ ID NO: 3119 - DNA, 1577 bp, Dehalobacter restrictus
  ref <308>: DATABASE ACCESSION NUMBER: NCBI ACCESSION: NZ_CP007033.1
  ref <309>: DATABASE ENTRY DATE: 2019-04-01
  ref <313>: RELEVANT RESIDUES IN SEQ ID NO: (1)..(1577)
ttttatggagagtttgatcctggctcaggacgaacgctggcggcgtgcctaacacatgcaagtcgaacggagatagttaatgaagcttgcgatttagctatcttagtggcgaacgggtgagtaacgcgtgggtaacctgcccttaagaccgggacaacagctggaaacggctgctaataccggatgtattgtccgagaggcatctcttggagaagaaagctggcctctgaaaatgctagcgcttagggatggacccgcgtctgattagctagttggtggggtagcggcctaccaaggcgacgatcagtagccggcctgagagggtaaacggccacactgggactgagacacggcccagactcctacgggaggcagcagtggggaatcttccgcaatggacgaaagtctgacggagcaacgccgcgtgtatgaagaaggccttcgggttgtaaaatactgttgttagggaagaacggcatctgtgtaaataatgcaggtgattgacggtacctaacgaggaagccccggctaactacgtgccagcagccgcggtaatacgtagggggcaagcgttgtccggaatcattgggcgtaaagggcgcgtaggcggcaatataagtctgatgtgaaagtgcggagcttaactccgtaaagcattggaaactgtatggcttgaggacaggagaggaaagtggaattccacgtgtagcggtgaaatgcgtagagatgtggaggaacaccagtggcgaaggcgactttctggactgtaactgacgctgaggcgcgaaagcgtggggagcgaacaggattagataccctggtagtccacgccgtaaacgatgaatgctaggtgtagagggtatcgaccccttctgtgccgcagttaacacaataagcattccgcctggggagtacggccgtcaaggttgaaactcaaaggaattgacgggggcccgcacaagcggtggagcatgtggtttaattcgacgcaacgcgaagaaccttaccaaggcttgacatccaactaatcccgtagagatatgggagtgcccttcggggaaagttgagacaggtggtgcatggttgtcgtcagctcgtgtcgtgagatgttgggttaagtcccgcaacgagcgcaacccctatatttagttgctaacaggtaaagctgagaactctagatagactgccggtgacaaaccggaggaaggtggggatgacgtcaaatcatcatgccccttatgtcttgggctacacacgtgctacaatggacggtacagacggaagcgaagccgcgaggtgaagcaaatccgagaaagccgttctcagttcggattgcaggctgcaactcgcctgcatgaagtcggaatcgctagtaatcgcaggtcagcacactgcggtgaatacgttcccgggccttgtacacaccgcccgtcacaccacgaaagtttgcaacacccgaagccggtggggtaaccgtaaggagccagccgtcgaaggtggggtagatgattggggtgaagtcgtaacaaggtagccgtatcggaaggtgcggctggatcacctcctttctaaggaga

SEQ ID NO: 3120 - DNA, 1671 bp, Dehalobacter sp. CF
  ref <308>: DATABASE ACCESSION NUMBER: NCBI ACCESSION: NC_018867.1
  ref <309>: DATABASE ENTRY DATE: 2019-04-01
  ref <313>: RELEVANT RESIDUES IN SEQ ID NO: (1)..(1671)
ttttatggagagtttgatcctggctcaggacgaacgctggcggcgtgcctaacacatgcaagtcgaacggtccgacgcctaacaccgaatgcttaagtgcaatagcaagcaacataagcgagtgcgcgagcgaagagagcgcaccacgcaaaaaaagcttgccaacacatgagtgagcattgggtgttaggcgaaggatagtggcgaacgggtgagtaacgcgtgggtaacctgcccttaagaccgggacaacagctggaaacggctgctaataccggatgtattatctgagaggcatctcttagagaagaaagctggcctctgaaaatgctagcgcttagggatggacccgcgtctgattagctagttggtggggtaaaggcctaccaaggcgacgatcagtagccggcctgagagggtaaacggccacactgggactgagacacggcccagactcctacgggaggcagcagtggggaatcttccgcaatggacgaaagtctgacggagcaacgccgcgtgtatgaagaaggccttcgggttgtaaaatactgttgttagggaagaacggcatctgtgtaaataatgcaggtgattgacggtacctaacgaggaagccccggctaactacgtgccagcagccgcggtaatacgtagggggcaagcgttgtccggaatcattgggcgtaaagggcgcgtaggcgggcttataagtctgatgtgaaagtgcggagcttaactccgtaaagcattggaaactgtaagtcttgaggacaggagaggaaagtggaattccacgtgtagcggtgaaatgcgtagagatgtggaggaacaccagtggcgaaggcgactttctggactgtaactgacgctgaggcgcgaaagcgtggggagcgaacaggattagataccctggtagtccacgccgtaaacgatgaatgctaggtgtagagggtatcgaccccttctgtgccgcagttaacacaataagcattccgcctggggagtacggccgcaaggttgaaactcaaaggaattgacgggggcccgcacaagcggtggagcatgtggtttaattcgacgcaacgcgaagaaccttaccaaggcttgacatccaactaatcccgtagagatatgggagtgcccttcggggaaagttgagacaggtggtgcatggttgtcgtcagctcgtgtcgtgagatgttgggttaagtcccgcaacgagcgcaacccctatatttagttgctaacaggtaaagctgagaactctagatagactgccggtgacaaaccggaggaaggtggggatgacgtcaaatcatcatgccccttatgtcttgggctacacacgtgctacaatggacggtacagacggaagcgaagccgcgaggtgaagcaaatccgagaaagccgttctcagttcggattgcaggctgcaactcgcctgcatgaagtcggaatcgctagtaatcgcaggtcagcacactgcggtgaatacgttcccgggccttgtacacaccgcccgtcacaccacgaaagtttgcaacacccgaagccggtggggtaaccgtaaggagccagccgtcgaaggtggggtagatgattggggtgaagtcgtaacaaggtagccgtatcggaaggtgcggctggatcacctcctttctagggaga

SEQ ID NO: 3121 - DNA, 1671 bp, Dehalobacter sp. DCA; identical to SEQ ID NO: 3120
  ref <308>: DATABASE ACCESSION NUMBER: NCBI ACCESSION: NC_018866.1
  ref <309>: DATABASE ENTRY DATE: 2019-04-01
  ref <313>: RELEVANT RESIDUES IN SEQ ID NO: (1)..(1671)

SEQ ID NO: 3122 - DNA, 1533 bp, Dehalobacter sp. FTH1
  misc_feature (325)..(325): n is a, c, g, or t
  misc_feature (1497)..(1497): n is a, c, g, or t
  ref <308>: DATABASE ACCESSION NUMBER: NCBI ACCESSION: NZ_AQYY01000001.1
  ref <309>: DATABASE ENTRY DATE: 2019-04-01
  ref <313>: RELEVANT RESIDUES IN SEQ ID NO: (1)..(1533)
ttcaacggagagtttgatcctggctcaggacgaacgctggcggcgtgcttaacacatgcaagtcgaacggtgacgaggagcttgctcctctgatcagtggcgaacgggtgagtaacacgtgagcaacctacccttgactctgggataacagttggaaacagctgctaataccggatacgaccctggcgggcatctgccggggtggaaagctccgacggtcagggatgggctcgcggcctatcagctagttggtgaggtaacggcccaccaaggcgacgacgggtagccggcctgagagggcgaccggccacactgggactgaganacggcccagactcctacgggaggcagcagtggggaatattgcgcaatgggcgaaagcctgacgcagcaacgccgcgtgcgggatgaaggccttcgggttgtaaaccgctttcagcagggacgaagggtttctgacggtacctgcagaagaagcaccggctaactacgtgccagcagccgcggtgatacgtagggtgcgagcgttgtccggaattattgggcgtaaagagcttgtaggcggtctgtcacgtcggaagtgaaaactcagggctcaaccctgagcctgctttcgatacgggcagacttgaggaatgtaggggagaacggaattcctggtggagcggtggaatgcgcagatatcaggaggaacaccagtggcgaaggcggttctctgggcatttcctgacgctgagaagcgaaagcgtggggagcaaacaggcttagataccctggtagtccacgccgtaaacggtgggcactaggtgtgggacctattccatgggttccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatccatagaatcctggagagatccgggagtgcccttcggggagctatgagacaggtggtgcatggttgtcgtcagctcgtgtcgtgagatgttgggttaagtcccgcaacgagcgcaaccctcgttctatgttgccagcggttcggccgggaactcatagaagactgccggggtcaactcggaggaaggtggggatgacgtcaagtcatcatgccccttatgtccagggcttcacgcatgctacaatggctggtacaaagggctgcaataccgcaaggtggagcgaatcccataaagccagtctcagttcggattggggtctgcaactcgaccccatgaagtcggagtcgctagtaatcgcagatcagcaacgctgcggtgaatacgttcccgggccttgtacacaccgcccgtcaagtcatgaaagtcggtaacacccgaagccggtggcctaacccttgtggagggagccgtcgaaggtgggaccggtaattaggactaagtcgtaacaaggtagccgtancggaaggtgcggctggatcacctcctttctaaggag

SEQ ID NO: 3123 - DNA, 411 bp, Dehalobacter sp. MCB1
  ref <308>: DATABASE ACCESSION NUMBER: NCBI ACCESSION: NZ_LXPC01000011.1
  ref <309>: DATABASE ENTRY DATE: 2019-04-01
  ref <313>: RELEVANT RESIDUES IN SEQ ID NO: (1)..(411)
tttatggagagtttgatcctggctcaggacgaacgctggcggcgtgcctaacacatgcaagtcgaacggtccggtatccaacaccgagcgcttcaaaggaattttgaggagcctgcgagtgcgcgaacgaagagagcgcaccacacttttaaaaagtgccaacacaggcggagcaaaatgggagtggagaaatcggtgttgggtattggatagtggcgaacgggtgagtaacgcgtgggtaacctgcccttaagaccgggacaacagctggaaacggctgctaataccggatgtattgtctgagaggcatctcttggagaagaaagctggcctctgaaaatgctagcgcttagggatggacccgcgtctgattagctagttggtggggtaaaggcctaccaaggcgacgat

SEQ ID NO: 3124 - DNA, 1576 bp, Dehalobacter sp. TeCB1
  ref <308>: DATABASE ACCESSION NUMBER: NCBI ACCESSION: NZ_MCHF01000064.1
  ref <309>: DATABASE ENTRY DATE: 2019-04-01
  ref <313>: RELEVANT RESIDUES IN SEQ ID NO: (1)..(1576)
ttttatggagagtttgatcctggctcaggacgaacgctggcggcgtgcctaacacatgcaagtcgaacggagatagttaatgaagcttgcgatttagctatcttagtggcgaacgggtgagtaacgcgtgggtaacctgcccttaagaccgggacaacagctggaaacggctgctaataccggatgtattgtccgagaggcatctcttggagaagaaagctggcctctgaaaatgctagcgcttagggatggacccgcgtctgattagctagttggtggggtagcggcctaccaaggcgacgatcagtagccggcctgagagggtaaacggccacactgggactgagacacggcccagactcctacgggaggcagcagtggggaatcttccgcaatggacgaaagtctgacggagcaacgccgcgtgtatgaagaaggccttcgggttgtaaaatactgttgttagggaagaacggcatctgtgtaaataatgcaggtgattgacggtacctaacgaggaagccccggctaactacgtgccagcagccgcggtaatacgtagggggcaagcgttgtccggaatcattgggcgtaaagggcgcgtaggcggcaatataagtctgatgtgaaagtgcggagcttaactccgtaaagcattggaaactgtatggcttgaggacaggagaggaaagtggaattccacgtgtagcggtgaaatgcgtagagatgtggaggaacaccagtggcgaaggcgactttctggactgtaactgacgctgaggcgcgaaagcgtggggagcgaacaggattagataccctggtagtccacgccgtaaacgatgaatgctaggtgtagagggtatcgaccccttctgtgccgcagttaacacaataagcattccgcctggggagtacggccgcaaggttgaaactcaaaggaattgacgggggcccgcacaagcggtggagcatgtggtttaattcgacgcaacgcgaagaaccttaccaaggcttgacatccaactaatcccgtagagatatgggagtgcccttcggggaaagttgagacaggtggtgcatggttgtcgtcagctcgtgtcgtgagatgttgggttaagtcccgcaacgagcgcaacccctatatttagttgctaacaggtaaagctgagaactctagatagactgccggtgacaaaccggaggaaggtggggatgacgtcaaatcatcatgccccttatgtcttgggctacacacgtgctacaatggacggtacagacggaagcgaagccgcgaggtgaagcaaatccgagaaagccgttctcagttcggattgcaggctgcaactcgcctgcatgaagtcggaatcgctagtaatcgcaggtcagcacactgcggtgaatacgttcccgggccttgtacacaccgcccgtcacaccacgaaagtttgcaacacccgaagccggtggggtaaccgtaaggagccagccgtcgaaggtggggtagatgattggggtgaagtcgtaacaaggtagccgtatcggaaggtgcggctggatcacctcctttctaaggaga

SEQ ID NO: 3125 - DNA, 1663 bp, Dehalobacter sp. UNSWDHB
  ref <308>: DATABASE ACCESSION NUMBER: NCBI ACCESSION: NZ_AUUR01000147.1
  ref <309>: DATABASE ENTRY DATE: 2019-04-01
  ref <313>: RELEVANT RESIDUES IN SEQ ID NO: (1)..(1663)
agagtttgatcctggctcaggacgaacgctggcggcgtgcctaacacatgcaagtcgaacggtccgacgcctaacaccgaatgcttaagtgcaatagcaagcaacataagcgagtgcgcgagcgaagagagcgcaccacgcaaaaaaagcttgccaacacatgagtgagcattgggtgttaggcgaaggatagtggcgaacgggtgagtaacgcgtgggtaacctgcccttaagaccgggacaacagctggaaacggctgctaataccggatgtattatctgagaggcatctcttagagaagaaagctggcctctgaaaatgctagcgcttagggatggacccgcgtctgattagctagttggtggggtaaaggcctaccaaggcgacgatcagtagccggcctgagagggtaaacggccacactgggactgagacacggcccagactcctacgggaggcagcagtggggaatcttccgcaatggacgaaagtctgacggagcaacgccgcgtgtatgaagaaggccttcgggttgtaaaatactgttgttagggaagaacggcatctgtgtaaataatgcaggtgattgacggtacctaacgaggaagccccggctaactacgtgccagcagccgcggtaatacgtagggggcaagcgttgtccggaatcattgggcgtaaagggcgcgtaggcgggcttataagtctgatgtgaaagtgcggagcttaactccgtaaagcattggaaactgtaagtcttgaggacaggagaggaaagtggaattccacgtgtagcggtgaaatgcgtagagatgtggaggaacaccagtggcgaaggcgactttctggactgtaactgacgctgaggcgcgaaagcgtggggagcgaacaggattagataccctggtagtccacgccgtaaacgatgaatgctaggtgtagagggtatcgaccccttctgtgccgcagttaacacaataagcattccgcctggggagtacggccgcaaggttgaaactcaaaggaattgacgggggcccgcacaagcggtggagcatgtggtttaattcgacgcaacgcgaagaaccttaccaaggcttgacatccaactaatcccgtagagatatgggagtgcccttcggggaaagttgagacaggtggtgcatggttgtcgtcagctcgtgtcgtgagatgttgggttaagtcccgcaacgagcgcaacccctatatttagttgctaacaggtaaagctgagaactctagatagactgccggtgacaaaccggaggaaggtggggatgacgtcaaatcatcatgccccttatgtcttgggctacacacgtgctacaatggacggtacagacggaagcgaagccgcgaggtgaagcaaatccgagaaagccgttctcagttcggattgcaggctgcaactcgcctgcatgaagtcggaatcgctagtaatcgcaggtcagcacactgcggtgaatacgttcccgggccttgtacacaccgcccgtcacaccacgaaagtttgcaacacccgaagccggtggggtaaccgtaaggagccagccgtcgaaggtggggtagatgattggggtgaagtcgtaacaaggtagccgtatcggaaggtgcggctggatcacctcctttctagggaga

SEQ ID NO: 3126 - DNA, 1495 bp, Dehalococcoides sp. UCH007
  ref <308>: DATABASE ACCESSION NUMBER: NCBI ACCESSION: NZ_AP014722.1
  ref <309>: DATABASE ENTRY DATE: 2019-04-01
  ref <313>: RELEVANT RESIDUES IN SEQ ID NO: (1)..(1495)
ggagagtttgatcctggctcaggatgaacgctagcggcgtgccttatgcatgcaagtcgaacggtcttaagcaattaagatagtggcaaacgggtgagtaacgcgtaagtaacctacctctaagtgggggatagcttcgggaaactgaaggtaataccgcatgtggtgggccgacataagttggttcactaaagccgtaaggcgcttggtgaggggcttgcgtccgattagctagttggtggggtaacggcctaccaaggcttcgatcggtagctggtctgagaggatgatcagccacactgggactgagacacggcccagactcctacgggaggcagcagcaaggaatcttgggcaatgggcgaaagcctgacccagcaacgccgcgtgagggatgaaggctctcgggttgtaaacctcttttcacagggaagaataatgacggtacctgtggaataagcttcggctaactacgtgccagcagccgcggtaatacgtaggaagcaagcgttatccggatttattgggcgtaaagtgagcgtaggtggtctttcaagttggatgtgaaatttcccggcttaaccgggacgtgtcattcaatactgttggactagagtacagcaggagaaaacggaattcccggtgtagtggtaaaatgcgtagatatcgggaggaacaccagaggcgaaggcggttttctaggttgtcactgacactgaggctcgaaagcgtggggagcgaacagaattagatactctggtagtccacgccttaaactatggacactaggtatagggagtatcgaccctctctgtgccgaagctaacgctttaagtgtcccgcctggggagtacggtcgcaaggctaaaactcaaaggaattgacgggggcccgcacaagcagcggagcgtgtggtttaattcgatgctacacgaagaaccttaccaagatttgacatgcatgaagtagtgaaccgaaagggaaacgacctgttaagtcaggagtttgcacaggtgctgcatggctgtcgtcagctcgtgccgtgaggtgtttggttaagtcctgcaacgagcgcaacccttgttgctagttaaattttctagcgagactgccccgcgaaacggggaggaaggtggggatgacgtcaagtcagcatggcctttatatcttgggctacacacacgctacaatggacagaacaataggttgcaacagtgtgaactggagctaatcctcaaagctgtcctcagttcggattgcaggctgaaacccgcctgcatgaagttggagttgctagtaaccgcatatcagcaaggtgcggtgaatacgttctcgggccttgtacacaccgcccgtcacgtcatgaaagccggtaacacttgaagtcgatgtgccaaccgcaaggaggcagtcgccgagggtgggactggtaattgggacgaagtcgtaacaaggtagccgtagcggaagctgcggctggatcacctcctttcta

SEQ ID NO: 3127 - DNA, 1494 bp, Dehalogenimonas alkenigignens
  ref <308>: DATABASE ACCESSION NUMBER: NCBI ACCESSION: NZ_QEFQ01000005.1
  ref <309>: DATABASE ENTRY DATE: 2019-04-01
  ref <313>: RELEVANT RESIDUES IN SEQ ID NO: (1)..(1494)
tggagagtttgatcctggctcaggatgaacgctagcggcgcgccttatgcatgcaagtcgcacggtcccgcaagggacagtggcaaacgggtgagtaatggataagtaacctgcccttaagtgggggataacacttcgaaagaagtgctaataccgcatgtggtgctctttcacaagaaggatcactaaaaccgcaaggtgcttgaggaggggcttgtctccgattagctagttggtggggtaacggcctaccaaggcgatgatcggtagctggtctgagaggatggtcagccacactgggactgagacacggcccagactcctacgggaggcagcagcaaggaatcttgggcaatgggcgaaagcctgacccagcgacgccgcgtgagggatgacggccttcgggttgtaaacctcttttctcagggaagaataatgacggtacctgaggaataagtctcggctaactacgtgccagcagccgcggtaatacgtaggaggcgagcgttatccggatttattgggcgtaaagtgggcgtaggtggtctttcaagtcggatgtgaaatctcccggctcaactgggaggggtcatccgatactgttggacttgagtacagcaggggaaaatggaattcccggtgtagtggtgaaatgcgtagatatcgggaggaacaccagaggcgaaggcgattttccaggctgaaactgacactgaggcccgaaagcgtggggagcgaacaggattagataccctggtagtccacgccttaaactatgggtactaggtatagggagtatcgaccctctctgtgccgaagctaacgctttaagtaccccgcctggggagtacggtcgcaagactaaaactcaaaggaattgacgggggcccgcacaagcagcggagcgtgtggtttaattcgatgctacacgaagaacctcaccaaggcttgacatgttagaagtagtgaaccgaaaggggaacgacctgtcaaatcaggagctatcacaggtgctgcatggctgtcgtcagctcgtgccgtgaggtgtatggttaagtcctgcaacgagcgcaacccttattgccagttatattctctggcgatactgcctcgcaaaacggggaggaaggtggggatgacgtcaagtcagcatggcctttatgccttgggctacacacacgctacaatgggcggcacaatgggttgccaccgggtgaccgggagctaatccccaaaaccgccctcagttcggatcgcaggctgaaacccgcctgcgtgaagtcggagttgctagtaaacgcgtgtcagcatagcgcgttgaatacgttctcgggccttgtacacaccgcccgtcacgtcatgaaagctggtaacacctgaagtcgataggctaacccgcaaggggggcagtcgcccaaggtgggactggtaattgggacgaagtcgtaacaaggtagccgtagcggaagctgcggctggatcacctcctttcta

SEQ ID NO: 3128 - DNA, 1497 bp, Dehalogenimonas lykanthroporepellens
  ref <308>: DATABASE ACCESSION NUMBER: NCBI ACCESSION: NC_014314.1
  ref <309>: DATABASE ENTRY DATE: 2019-04-01
  ref <313>: RELEVANT RESIDUES IN SEQ ID NO: (1)..(1497)
ggagagtttgatcctggctcaggatgaacgctagcggcgcgccttatgcatgcaagtcgaacggtctctcgcaagagagatagtggcaaacgggtgagtaataggtaagtaacctgcccttaagtgggggataacacttcgaaagaagtgctaataccgcatgtggtgctctttcacaaggaagagtactgaagtcgaaagacgcttgaggaggggcttgcctccgattagctagttggtggggtaacggcctaccaaggttatgatcggtagctggtctgagaggatggtcagccacactggaactgagacacggtccagactcctacgggaggcagcagcaaggaatcttgggcaatgggcgaaagcctgacccagcgacgccgcgtgagggatgacggccttcgggttgtaaacctcttttctcagggaagaataatgacggtacctgaggaataagtctcggctaactacgtgccagcagccgcggtaatacgtaggaggcgagcgttatccggatttattgggcgtaaagtgggcgtaggtggtctttcaagtcagatgtgaaatctcccggctcaactgggaggggtcatctgatactgttggacttgagtatggcaggagaaaacggaattcccggtgtagtggtgaaatgcgtagatatcgggaggaacaccagaggcgaaggcggttttctaggccaaaactgacactgaggcccgaaagcgtggggagcgaacaggattagataccctggtagtccacgccctaaacactgggtactaggtatagggagtatcgaccctctctgtgccgaagctaacgctttaagtaccccgcctggggagtacggtcgcaagactaaaactcaaaggaattgacgggggcccgcacaagcagcggagcgtgtggtttaattcgatgctacacgaagaacctcaccagggcttgacatgttagaagtagtgaaccgaaaggggatccacctgtcaagtcaggagctatcacaggtgctgcatggctgtcgtcagctcgtgccgtgaggtgtatggttaagtcctgcaacgagcgcaacccctattgctagttacattctctagcgatactgcctcgcaaaacggggaggaaggtggggatgacgtcaagtcagcatggcctttatgccctgggctacacacacgctacaatgggcggtacaatgggttgccaccgggtgaccgggagctaatccccaaaaccgtcctcagttcggattgcaggctgaaactcgcctgcatgaagtcggagttgctagtaaacgcgtgtcagcatagcgcgttgaatacgttctcgggccttgtacacaccgcccgtcacgtcatgaaagttggtaacacctgaagtcgataggctaacccgcaagggaggcagtcgcccaaggtgggactgatgattgggacgaagtcgtaacaaggtagccgtagcggaagctgcggctggatcacctcctttcta

SEQ ID NO: 3129 - DNA, 1497 bp, Dehalogenimonas sp. GP
  ref <308>: DATABASE ACCESSION NUMBER: NCBI ACCESSION: NZ_JQAN02000001.1
  ref <309>: DATABASE ENTRY DATE: 2019-04-01
  ref <313>: RELEVANT RESIDUES IN SEQ ID NO: (1)..(1497)
tggagagtttgatcctggctcaggatgaacgctagcggcgcgccttatgcatgcaagtcgtacggtttatcgcaagatagacagtggcaaacgggtgagtaatagttaggtaacctgcctttaagtgggggataacacttcgaaagaagtgctaataccgcatgtggtgctctttcataagaaggatcactaaaaccgcaaggtgcttgaagaggggcctgattccgattagctagttggtgaggtaacggcccaccaaggctgggatcggtagctggtctgagaggatggtcagccacactgggactgagacacggcccagactcctacgggaggcagcagcaaggaatcttgggcaatgggcgaaagcctgacccagcgacgccgcgtgagggatgaaggccttcgggttgtaaacctcttttctcagggaagaataatgacggtacctgaggaataagtctcggctaactacgtgccagcagccgcggtaatacgtaggaggcgagcgttatccggatttattgggcgtaaagtgggcgtaggtggtctttcaagtcggatgtgaaatctcctggcttaactgggaggggtcatccgatactgttggacttgagtacagcaggggaaaatggaattcccggtgtagtggtgaaatgcgtagatatcgggaggaacaccagaggcgaaggcgattttccaggctgaaactgacactgaggcccgaaagcgtggggagcgaacaggattagataccctggtagtccacgccttaaactatgggtactaggtatagggagtatcgaccctttctgtgccgaagctaacgctttaagtaccccgcctggggagtacggtcgcaagactaaaactcaaaggaattgacgggggcccgcacaagcagcggagcgtgtggtttaattcgatgctacacgaagaacctcaccagggcttgacatgttagaagtaatgaactgaaaagggaatgacctgttaaatcaggagctatcacaggtgctgcatggctgtcgtcagctcgtgtcgtgagatgtatggttaagtcctgcaacgagcgcaacccttattgccagttatattctctggcgatactgcctcgcaaaacggggaggaaggtggggatgacgtcaagtcagcatggcctttatgccctgggctacacacacgctacaatggacggtacaatgggttgccaccgggcgaccgggagctaatctccaaaaccgtcctcagttcggatcgcaggctgaaacccgcctgcgtgaagtcggagttgctagtaaacgcgtgtcagcatagcgcgttgaatacgttctcgggccttgtacacaccgcccgtcacgtcatgaaagctggtaacacctgaagtcgataggctaacccgcaaggggggcagtcgcccaaggtgggactggtgattgggacgaagtcgtaacaaggtagccgtagcggaagctgcggctggatcacctcctttct

SEQ ID NO: 3130 - DNA, 1503 bp, Deinococcus ficus
  ref <308>: DATABASE ACCESSION NUMBER: NCBI ACCESSION: NZ_CP021081.1
  ref <309>: DATABASE ENTRY DATE: 2019-04-01
  ref <313>: RELEVANT RESIDUES IN SEQ ID NO: (1)..(1503)
catggagagtttgattctggctcagggtgaacgctggcggcgtgcttaagacatgcaagtcgaacgcagtcttcggactgagtggcgcacgggtgagtaacacgtaactgacctacccccaagtcgcggataactggccgaaaggtcagctaatacgtgatgtgatgtcccctttctggggggccattaaaggtttactgcttggggatggggttgcgttccatcagctagttggcggggtaaaggcccaccaaggcaacgacggatagccggcctgagagggtggccggccacaggggcactgagacacgggtcccactcctacgggaggcagcagttaggaatcttccacaatgggcgaaagcctgatggagcgacgccgcgtgagggatgaaggttctcggatcgtaaacctctgaatcagggacgaaagacgcgtaagcgggatgacggtacctgagtaatagcaccggctaactccgtgccagcagccgcggtaatacggagggtgcaagcgttacccggaatcactgggcgtaaagggcgtgtaggcggttatttaagtctggttttaaagaccggggctcaaccccgggagtggactggatactggatgacttgacctctggagagggaactggaattcctggtgtagcggtggaatgcgtagataccaggaggaacaccaatggcgaaggcaagttcctggacagaaggtgacgctgaggcgcgaaagtgtggggagcgaaccggattagatacccgggtagtccacaccctaaacgatgtacgttggctaaccgcaggatgctgtggtcggcgaagctaacgcgataaacgtaccgcctgggaagtacggccgcaaggttgaaactcaaagaaattgacgggggcccgcacaagcggtggagcatgtggtttaattcgaagcaacgcgaagaaccttaccaggtcttgacatccatggaactcctgagagatcaggaggtgcccttcggggagccatgagacaggtgctgcatggctgtcgtcagctcgtgtcgtgagatgttgggttaagtcccgcaacgagcgcaacccttacctttagttgtcagcattcggttggacactctagagggactgcctatgaaagtaggaggaaggcggggatgacgtctagtcagcatggtccttacgacctgggctacacacgtgctacaatggatgggacaacgcgctgccagcctgcgaaggtgcgcgaatcgctgaaacccatccccagttcagatcggagtctgcaactcgactccgtgaagttggaatcgctagtaatcgcaggtcagcatactgcggtgaatacgttcccgggccttgtacacaccgcccgtcacaccatgggagtacgttgcagttgaaaccgccgggagccgcaaggcaggcgtctagactgtggcgcatgactggggtgaagtcgtaacaaggtaactgtaccggaaggtgcggttggatcacctcctttct

SEQ ID NO: 3131 - DNA, 1514 bp, Deinococcus metallilatus
  ref <308>: DATABASE ACCESSION NUMBER: NCBI ACCESSION: NZ_SDEC01000055.1
  ref <309>: DATABASE ENTRY DATE: 2019-04-01
  ref <313>: RELEVANT RESIDUES IN SEQ ID NO: (1)..(1514)
ttgatggagagtttgatcctggctcagggtgaacgctggcggcgtgcttaagacatgcaagtcgaacgcaccccctcgggggtgagtggcgcacgggtgaggaacacgtaactgacctgcccccaagttccgaataaccctccgaaaggagggctaatacgggatgtgctgcaccgctgtggcggtgcagtaaaggtcgcaagactgcttggggatggggttgcgttccatcagctagatggtggggtaaaggcctaccatggcgacgacggatcaccggcctgagagggtggccggtcacaggggcactgagacacgggccccactcctacgggaggcagcagttaggaatcttccccaatgggcgcaagcctgagggagcgacgccgcgtgagggatgaaggtcctcggatcgtaaacctctgaatcaacgacgaaagaccacttcggtggggatgacggtagttgagtaatagcaccggctaactccgtgccagcagccgcggtaatacggagggtgcaagcgttacccggaatcactgggcgtaaagggcgtgtaggcggaccgttaagtctgactttaaagaccgccgctcaacggcgggcgtgggttggatactggtggtctggacctctggagagagaaccggaattcctggtgtagcggtggaatgcgtagataccaggaggaacaccgatggcgaaggcaggttcttggacagaaggtgacgctgaggcgcgaaagtgtggggagcgaaccggattagatacccgggtagtccacaccctaaacgatgcacgttggctcatggcgggatgccgtcatgggcgaagccaacgcgataaacgtgccgcctgggaagtacggccgcaaggttgaaactcaaaggaattgacgggggcccgcacaagcggtggagcatgtggtttaattcgaagcaacgcgaagaaccttaccaggtcttgacatcccaagaacccctccgaaaagagggggtgcccttcggggagcttggagacaggtgctgcatggctgtcgtcagctcgtgtcgtgagatgttgggttaagtcccgcaacgagcgcaacccttgcccttagttgccagcaccttgggtgggcactctagggggactgccggtgaaagccggaggaaggcggggatgacgtctagtcagcatggtccttacgacctgggcgacacacgtgctacaatgaccaggacaacgcgccgcaaacctgcgagggtcagccaatcgctgaaacctggtcccagttcagatcggagtctgcaactcgactccgtgaaggtggaatcgctagtaatcgcgggtcagcataccgcggtgaatacgttcccgggccttgtacacaccgcccgtcacaccatgggagtacagtgcagctaaaaccaccgggagcttgacggcaggtgtctaggctgtgctgcatgactggggtgaagtcgtaacaaggtaactgtaccggaaggtgcggttggatcacctcctttcta

SEQ ID NO: 3132 - DNA, 1505 bp, Deinococcus radiophilus
  ref <308>: DATABASE ACCESSION NUMBER: NCBI ACCESSION: NZ_RXPE01000073.1
  ref <309>: DATABASE ENTRY DATE: 2019-04-01
  ref <313>: RELEVANT RESIDUES IN SEQ ID NO: (1)..(1505)
atggagagtttgatcctggctcagggtgaacgctggcggcgtgcttaagacatgcaagtcgaacggcccagcttgctgggcagtggcgcacgggtgagtaacacgtgactgacctaccccgaagttctgaataacctggcgaaagtcgggctaatacaggatgtgcagtatcgctgtggcgatactgcaaaggtttaccgctttgggatggggttgcgttccatcagctagatggtggggtaaaggcctaccatggcgacgacggatagccggcctgagagggtggccggccacaggggcactgagacacgggtcccactcctacgggaggcagcagttaggaatcttccacaatgggcgaaagcctgatggagcgacgccgcgtgagggatgacggttttcggattgtaaacctctgaatcagggacgaaagggcctttatggcagatgacggtacctgagtaatagcaccggctaactccgtgccagcagccgcggtaatacggagggtgcgagcgttacccggaatcactgggcgtaaagggcgtgtaggcgggatgttaagtccggtcttaaagaccgcagctcaactgcgggagtggactggatactggcactctggacctctggagaggtagctggaatttctggtgtagcggtggaatgcgtagataccagaaggaacaccaatggcgaaggcaggctactggacagaaggtgacgctgaggcgcgaaagtgtggggagcgaaccggattagatacccgggtagtccacaccctaaacgatgtacgttggcagatcgcaggatgctgtgatttgcgaagctaacgcgataaacgtaccgcctgggaagtacggccgcaaggttgaaactcaaaggaattgacgggggcccgcacaagcggtggagcatgtggtttaattcgaagcaacgcgaagaaccttaccagaccttgacatccacagaacgccgcggaagcgcggcggtgcccttcggggaactgtgagacaggtgctgcatggctgtcgtcagctcgtgtcgtgagatgttgggttaagtcccgcaacgagcgcaacccttgcctttagttgccagcatttaagttgggcactctagagggactgcctgtgaaagcaggaggaaggcggggatgacgtctagtcagcatggtccttacggtctgggctacacacgtgctacaatggccagtacaacgcgcagcaaacttgcgagagtgagcgaatcgctaaaagctggcctcagttcagattggagtctgcaactcgactccatgaagttggaatcgctagtaatcgtgggtcagcataccgcggtgaatacgttcccgggccttgtacacaccgcccgtcacaccatgggagtagattgcagctgaaaccgctgggagccgcaaggcaggcgtctaggctgtggtttatgactggggtgaagtcgtaacaaggtaggtgtaccggaaggtgcgcctggatcacctcctttct

SEQ ID NO: 3133 - DNA, 1506 bp, Deinococcus sp. K2S05-167
  ref <308>: DATABASE ACCESSION NUMBER: NCBI ACCESSION: NZ_QYUJ01000014.1
  ref <309>: DATABASE ENTRY DATE: 2019-04-01
  ref <313>: RELEVANT RESIDUES IN SEQ ID NO: (1)..(1506)
ttatttggagagtttgattctggctcagggtgaacgctggcggcgtgcttaagacatgcaagtcgaacgcagtcttcggactgagtggcgcacgggtgagtaacacgtaactgacctaccccaaagtcgcggataaccagccgaaaggttggctaatacgtgatgtgaacattcgccgtggcgaatgtttaaagacttgatcgctttgggatggggttgcgttccatcagctagttggtggggtaaaggcccaccaaggcaacgacggatagccggcctgagagggtggccggccacaggggcactgagacacgggtcccactcctacgggaggcagcagttaggaatcttccacaatgggcgaaagcctgatggagcgacgccgcgtgagggaagaaggttctcggatcgtaaacctctgaaccaacgacgaaagacccgacaagggagatgacggtagttgggtaatagcaccggctaactccgtgccagcagccgcggtaatacggagggtgcaagcgttacccggaatcactgggcgtaaagggcgtgtaggcggccacttaagtccgattttaaagaccgaagctcaacttcgggagtggattggatactggatggcttgacctctggagaggaaaccggaattcctggtgtagcggtggaatgcgtagataccaggaggaacaccaatggcgaaggcaggtttctggacagaaggtgacgctgaggcgcgaaagtgtggggagcgaaccggattagatacccgggtagtccacaccctaaacaatgtacgttggcttatggccggatgcggtcatgggcgaagctaacgcgataaacgtaccgcctgggaagtacggccgcaaggttgaaactcaaagaaattgacgggggcccgcacaagcggtggagtatgtggtttaattcgaagcaacgcgaagaaccttaccaggtcttgacatcctacgaaccttccggagatggaagggtgcccctcggggagcgtagagacaggtgctgcatggctgtcgtcagctcgtgtcgtgagatgttgggttaagtcccgcaacgagcgcaacccctacctttagttgctagcattgagttgagcactctagagggactgcctatgaaagtaggaggaaggcggggatgacgtctagtcagcatggtccttacgacctgggctacacacgtactacaatggccaagacaacgcgcagcaaacacgcgagtgtaagcgaatcgctgaaacttggccccagttcagatcggagtctgcaactcgactccgtgaagttggaatcgctagtaatcgcaggtcagcatactgcggtgaatacgttcccgggccttgtacacaccgcccgtcacaccatgggagtacgttgcagctaaaaccaccgggagccgcaaggcaggtgtctaggctgtggcgcatgactggggtgaagtcgtaacaaggtaactgtaccggaaggtgcggttggatcacctcctttc

SEQ ID NO: 3134 - DNA, 1504 bp, Deinococcus sp. RM
  ref <308>: DATABASE ACCESSION NUMBER: NCBI ACCESSION: NZ_QYCQ01000202.1
  ref <309>: DATABASE ENTRY DATE: 2019-04-01
  ref <313>: RELEVANT RESIDUES IN SEQ ID NO: (1)..(1504)
tttttggagagtttgatcctggctcagggtgaacgctggcggcgtgcttaagacatgcaagtcgaacgggctcttcggagccagtggcgcacgggtgagtaacgcgtaactgacctaccccaaagtcgcggataacgattcgaaagaatcgctaatacgtgatgtgctgtcagattgtgttctgccagtaaagatttattgctttgggatggggttgcgttccatcagctagttggtggggtaaaggcccaccaaggcaacgacggatagccggcctgagagggtggccggccacaggggcactgagacacgggtcccactcctacgggaggcagcagttaggaatcttccacaatgggcgaaagcctgatggagcgacgccgcgtgagggatgaaggtcttcggatcgtaaacctctgaatcagggacgaaagacgcgtaagcgggatgacggtacctgagtaatagcaccggctaactccgtgccagcagccgcggtaatacggagggtgcaagcgttacccggaatcactgggcgtaaagggcgtgtaggcggacacttaagtctggttttaaagactgcggctcaaccgcagggatggactggatactgggtgtcttgacctctggagagagaactggaattcctggtgtagcggtggaatgcgtagataccaggaggaacaccaatggcgaaggcaggttcttggacagaaggtgacgctgaggcgcgaaagtgtggggagcgaaccggattagatacccgggtagtccacaccctaaacgatgtacgttggctaaccgcaggatgctgtggttggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatgcatggaacctttcagagatgagagggtgcccttcggggagccatgacacaggtgctgcatggctgtcgtcagctcgtgtcgtgagatgttgggttaagtcccgcaacgagcgcaacccttacctttagttgccagcattgagttgggcactctagagggactgcctatgaaagtaggaggaaggcggggatgacgtctagtcagcatggtccttacgacctgggctacacacgtgctacaatggatgggacaacgcgcagccaacttgcgaaagtgagcgaatcgctgaaacccatccccagttcagatcggagtctgcaactcgactccgtgaagttggaatcgctagtaatcgcaggtcagcatactgcggtgaatacgttcccgggccttgtacacaccgcccgtcacaccatgggagtaaattgcagctgaaaccgccgggagcctcacggcaggcgtctaggctgtggttcatgactggggtgaagtcgtaacaaggtaactgtaccggaaggtgcggttggatcacctcctttct

SEQ ID NO: 3135 - DNA, 1510 bp, Deinococcus sp. S14-83
  ref <308>: DATABASE ACCESSION NUMBER: NCBI ACCESSION: NZ_CP034183.1
  ref <309>: DATABASE ENTRY DATE: 2019-04-01
  ref <313>: RELEVANT RESIDUES IN SEQ ID NO: (1)..(1510)
tatatggagagtttgatcctggctcagggtgaacgctggcggcgtgcttaagacatgcaagtcgaacgggaagagcttgctcttctagtggcgcacgggtgagtaacgcgtaactgacctacctccaagttcagcataacgtctcgaaagagacgctaattctgaatgtgatcccacctcatgtggtgtgattaaagaatttcgcttggagatggggttgcgttccatcagctagatggtggggtaaaggcctaccatggcgacgacggataaccggcctgagagggtggccggtcacaggggcactgagacacgggtcccactcctacgggaggcagcagttaggaatcttccacaatgggcgcaagcctgatggagcgacgccgcgtgagggatgaaggttttcggatcgtaaacctctgaatcagggacgaaagaccagcttgactggggatgacggtacctgagtaatagcaccggctaactccgtgccagcagccgcggtaatacggagggtgcaagcgttacccggaatcactgggcgtaaagggcgtgtaggcggtttgccaagtctgactttaaagaccgaagctcaacttcgggaatgggttggagactggcagactagacggatggagaggtcactggaattcctggtgtagcggtggaatgcgtagataccaggaggaacaccaacggcgaaggcaggtgactggacatttagtgacgctgaggcgcgaaagtgtggggagcaaaccggattagatacccgggtagtccacaccctaaacgatgtacgttggctaggcgcaggatgctgtggttggcgaagttaacacgataaacgtaccgcctgggaagtacggccgcaaggttgaaactcaaaggaattgacgggggcccgcacaagcggtggagcatgtggtttaattcgaagcaacgcgaagaaccttaccagatcttgacatgtcccaaacccaccggaaccggtggggtgcccttcggggaatgggaacacaggtgctgcatggctgtcgtcagctcgtgtcgtgagatgttgggttaagtcccgcaacgagcgcaacccctaccttttgttgctaacggttcggccgagaactcaagaggaactgcctatgaaagtaggaggaaggcggggatgacgtctagtcagcatggtccttacggtctgggctacacacgtgctacaatggccgatacaacgcgcagcaagctcgcgagagcaagccaatcgctaaaagtcggccccagttcagatcggagtctgcaactcgactccgtgaagttggaatcgctagtaatcgtgaatcagcatgtcgcggtgaatacgttcccgggccttgtacacaccgcccgtcacaccatgggagttgattgcagctcaaaccgccgggagctgaaaggcaggcgtctaggctgtggttggtgactagggtgaagtcgtaacaaggtaactgtaccggaaggtgcggttggatcacctcctttc

SEQ ID NO: 3136 - DNA, 1506 bp, Deinococcus wulumuqiensis
  ref <308>: DATABASE ACCESSION NUMBER: NCBI ACCESSION: NZ_CP031158.1
  ref <309>: DATABASE ENTRY DATE: 2019-04-01
  ref <313>: RELEVANT RESIDUES IN SEQ ID NO: (1)..(1506)
tttatggagagtttgatcctggctcagggtgaacgctggcggcgtgcttaagacatgcaagtcgaacgcggtcttcggaccgagtggcgcacgggtgagtaacacgtaactgacctacccagaagtcatgaataactggccgaaaggtcagctaatacgtgatgtggtgatttgccgtggcaaatcactaaagatttatcgcttctggatggggttgcgttccatcagctggttggtggggtaaaggcctaccaaggcgacgacggatagccggcctgagagggtggccggccacaggggcactgagacacgggtcccactcctacgggaggcagcagttaggaatcttccacaatgggcgcaagcctgatggagcgacgccgcgtgagggatgaaggttttcggatcgtaaacctctgaatctgggacgaaagagccttcgggcagatgacggtaccagagtaatagcaccggctaactccgtgccagcagccgcggtaatacggagggtgcaagcgttacccggaatcactgggcgtaaagggcgtgtaggcggatatttaagtctggttttaaagaccgaggctcaacctcgggagtggactggatactggatgtcttgacctctggagaggtaactggaattcctggtgtagcggtggaatgcgtagataccaggaggaacaccaatggcgaaggcaagttactggacagaaggtgacgctgaggcgcgaaagtgtggggagcaaaccggattagatacccgggtagtccacaccctaaacgatgtacgttggctaagcgcaggatgctgtgcttggcgaagctaacgcgataaacgtaccgcctgggaagtacggccgcaaggttgaaactcaaaggaattgacgggggcccgcacaagcggtggagcatgtggtttaattcgaagcaacgcgaagaaccttaccaggtcttgacatgctaggaaggcgctggagacagcgccgtgcccttcggggaacctagacacaggtgctgcatggctgtcgtcagctcgtgtcgtgagatgttgggttaagtcccgcaacgagcgcaacccttgcctttagttgtcagcattcagttggacactctagagggactgcctgtgaaagcaggaggaaggcggggatgacgtctagtcagcatggtccttacgtcctgggctacacacgtgctacaatggataggacaacgcgcagcaaacatgcgagtgtaagcgaatcgctgaaacctatccccagttcagatcggagtctgcaactcgactccgtgaagttggaatcgctagtaatcgcgggtcagcataccgcggtgaatacgttcccgggccttgtacacaccgcccgtcacaccatgggagtagattgcagttgaaaccgccgggagcctcacggcaggcgtctagactgtggtttatgactggggtgaagtcgtaacaaggtaactgtaccggaaggtgcggttggatcacctcctttctat

SEQ ID NO: 3137 - DNA, 1556 bp, Denitrovibrio acetiphilus
  ref <308>: DATABASE ACCESSION NUMBER: NCBI ACCESSION: NC_013943.1
  ref <309>: DATABASE ENTRY DATE: 2019-04-01
  ref <313>: RELEVANT RESIDUES IN SEQ ID NO: (1)..(1556)
atggagagtttgatcctggctcagaacgaacgctggcggcgtgcttaacacatgcaagtcaaggggaaagtcacttcggtggcgattacactggcgcacgggtgagtaacgcgtgaggaatctaccattaagtttgggacaacattccgaaaggggtgctaataccggataatatacgcattcgcatgtttgtgtaggaaaggcggtttcggctgtcgctttttgatgatctcgcgtatcattagatagttggtgaggtaacggctcaccaagtctacgatgattagccggcctgagagggtggccggccacatagggactgagacacggccctaactcctacgggaggcagcagtggggaattttgcgcaatgaccgaaaggttgacgcagcgacgccgcgtgtatgacgaaggttttcggatcgtaaagtactttcagcagggaagaaatggttcaatagtaactgattgagttttgacggtacctgcagaagcagccccggctaactccgtgccagcagccgcggtaatacggagggggcaagcgttgttcggagtcactgggcgtaaagcgcacgtaggtggattatcaagtcaggagttaaaggcaacggctcaaccgttgtaaggcttttgaaactggtagtctagagtgttggagaggaatgcggaatttccggtgtagcggtgaaatgcgtagatatcggaaggaacaccagttgcgaaggcggcattctggccaataactgacactgaggtgcgagagcatgggtagcaaacaggattagataccctggtagtccatgctgtaaacgatggatgctaggtgttggggtttatacgcctcagtgccgaagctaacgcattaagcatcccgcctggggagtacggccgcaaggctgaaactcaaaggaattgacgggggcccgcacaagcggtggagcacgtggtttaattcgatgctaaccgtagaaccttacctgggcttgacatccgtagtcgtttctagagatagaaatttgctcatctttgatgagagctatgagacaggtgctgcatggctgtcgtcagctcgtgccgtgaggtgttgggttaagtcccgcaacgagcgcaacccctatttttagttgccatcaggtaatgctgggcactctaaagagacagccgtcgataaggcggaggaaggtggggacgacgtcaagtcatcatggcccttatgtccagggctacacacgtgctacaatggttcatacagagggcagctaactcgtgagagtacgcgaatcccttaaagtggatctcagttcggattgtaatctgcaactcgattacatgaagctggaatcgctagtaatcgcaggtcagctaaactgcggtgaatacgttcccgggccttgtacacaccgcccgtcacaccacgggagtcgaccgtacctgaagccggtggcctaaccttttaggagggagccgtctatggtatagttggtaactggggtgaagtcgtaacaaggtagccgtaccggaaggtgtggctggatcacctcctttctaagga

SEQ ID NO: 3138 - DNA, 1427 bp, Dermabacter sp. HSID17554
  ref <308>: DATABASE ACCESSION NUMBER: NCBI ACCESSION: NZ_RBLW01000013.1
  ref <309>: DATABASE ENTRY DATE: 2019-04-01
  ref <313>: RELEVANT RESIDUES IN SEQ ID NO: (1)..(1427)
ttttaatggagagtttgatcctggctcaggacgaacgctggcggcgtgcttaacacatgcaagtcgaacgatgaagctgtgcttgcacagtggattagtggcgaacgggtgagtaacacgtgagtaacctgcccttcactttgggataactccgagaaatcggggctaataccggatatgactactggccgcatggttggtggtggaaagtttttcggtgagggatgggctcgcggcctatcagtttgttggtgaggtagtggctcaccaaggcgatgacgggtagccggcctgagagggcgaccggccacactgggactgagacacggcccagactcctacgggaggcagcagtggggaatattgcacaatgggcgaaagcctgatgcagcgacgccgcgtgggggatgacggccttcgggttgtaaacctctttcagcaaggaagaagcgaaagtgacggtacttgcagaagaagcgccggctaactacgtgccagcagccgcggtaatacgtagggcgcaagcgttgtccggaattattgggcgtaaagagcttgtaggtggcttgtcgcgtctgccgtgaaaacccgaggcttaaccttgggcgtgcggtgggtacgggcaggctagagtgcggtaggggagactggaattcctggtgtagcggtgaaatgcgcagatatcaggaggaacaccgatggcgaaggcaggtctctgggccgttactgacactgagaagcgaaagcatggggagcgaacaggattagataccctggtagtccatgccgtaaacgttgggcactaggtgtggggagcattccacgttttccgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactggatcgctgcagagatgtggttttctttggactggtgcacaggtggtgcatggttgtcgtcagctcgtgtcgtgagatgttgggttaagtcccgcaacgagcgcaaccctcgttccatgttgccagcacttcgggtggggactcatgggagactgccggggtcaactcggaggaaggtggggacgacgtcaaatcatcatgccccttatgtcttgggcttcacgcgtgctacaatggtcggtacaatgggttgcgatactgtgaggtggagctaatcccaaaaagccggtctcagttcggattggggtctgcaactcgaccctatgaagtcggagtcgctagtaatcgcagatcagcaatgctgcggtgaatacgttcccgggccttgtacacaccgcccgtcaagtcacgaaagtcggtaacacccgaagccgatggcccaagct

SEQ ID NO: 3139 - DNA, 1450 bp, Dermacoccaceae bacterium RIT621
  ref <308>: DATABASE ACCESSION NUMBER: NCBI ACCESSION: NZ_SEIP01000033.1
  ref <309>: DATABASE ENTRY DATE: 2019-04-01
  ref <313>: RELEVANT RESIDUES IN SEQ ID NO: (1)..(1450)
cttgctggggtggattagtggcgaacgggtgagtaacacgtgagtaacctgcccttcactctgggataagccttggaaacgaggtctaatactggatattcatacatggtcgcatggttgtgtgtggaaagattttttggtgggggatggactcgcggcctatcagcttgttggtgaggtagtggctcaccaaggctttgacgggtagccggcctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagtagggacgaagcgagagtgacggtacctgcagaagaagcaccggctaactacgtgccagcagccgcggtaatacgtagggtgcgagcgttgtccggaattattgggcgtaaagagcttgtaggcggtttgtcgcgtctgctgtgaaagaccggggcttaactccggttctgcagtgggtacgggcaggctagagtatggtaggggagactggaattcctggtgtagcggtgaaatgcgcagatatcaggaggaacaccgatggcgaaggcaggtctctgggccattactgacgctgagaagcgaaagcatggggagcgaacaggattagataccctggtagtccatgccgtaaacgttgggcgctaggtgtgggactcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaagcatgcagagatgtgtgtgccttttggctggtgtacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtggggatgacgtcaaatcatcatgccccttatgtcttgggcttcacgcatgctacaatggctggtacagagggctgcgataccgtgaggtggagcgaatcccttaaaaccggtctcagttcggattggggtctgcaactcgaccccatgaagttggagtcgctagtaatcgcagatcagcagtgctgcggtgaatacgttcccgggccttgtacacaccgcccgtcaagtcacgaaagtcggtaacacccgaagccggtggcctaacccttgtggggggagccgtcgaaggtgggattggcgattgggactaagtcgtaacaaggtagccgtaccggaaggtgcggctggatcacctcctttctaagga

SEQ ID NO: 3140 - DNA, 1532 bp, Dermacoccus abyssi
  ref <308>: DATABASE ACCESSION NUMBER: NCBI ACCESSION: NZ_QWLM01000032.1
  ref <309>: DATABASE ENTRY DATE: 2019-04-01
  ref <313>: RELEVANT RESIDUES IN SEQ ID NO: (1)..(1532)
ttttaacggagagtttgatcctggctcaggacgaacgctggcggcgtgcttaacacatgcaagtcgaacgatgaagcgccagcttgctggtgtggattagtggcgaacgggtgagtaacacgtgagtaacctgccccctactctgggataagcctgggaaactgggtctaatactggatatgaccaatcactgcatggtgtgttggtggaaagattttttggtgggggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcaccagggacgaagctaacgtgacggtacctggagaagaagcaccggctaactacgtgccagcagccgcggtaatacgtagggtgcgagcgttgtccggaattattgggcgtaaagagcttgtaggcggtttgtcgcgtctgctgtgaaagaccggggcttaactccggttctgcagtgggtacgggcagactagagtatggtaggggagactggaattcctggtgtagcggtgaaatgcgcagatatcaggaggaacaccgatggcgaaggcaggtctctgggccattactgacgctgagaagcgaaagcatggggagcgaacaggattagataccctggtagtccatgccgtaaacgttgggcgctaggtgtggggctcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaatcatgcagagatgtgtgcgtcttcggactggtgtacaggtggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtggggatgacgtcaaatcatcatgccccttatgtcttgggcttcacgcatgctacaatggccggtacagagggttgcgaaactgtgaggtggagctaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgtaacaaggtagccgtaccggaaggtgcggctggatcacctcctttctaagga

SEQ ID NO: 3141 - DNA, 1529 bp, Dermacoccus sp. 147Ba
  ref <308>: DATABASE ACCESSION NUMBER: NCBI ACCESSION: NZ_SEHL01000021.1
  ref <309>: DATABASE ENTRY DATE: 2019-04-01
  ref <313>: RELEVANT RESIDUES IN SEQ ID NO: (1)..(1529)
taacggagagtttgatcctggctcaggacgaacgctggcggcgtgcttaacacatgcaagtcgaacgatgaagcgccagcttgctggtgtggattagtggcgaacgggtgagtaacacgtgagtaacctgccccctactctgggataagcctgggaaactgggtctaatactggatatgaccaatcactgcatggtgtgttggtggaaagattttttggtgggggatggactcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcaccagggacgaagctaacgtgacggtacctggagaagaagcaccggctaactacgtgccagcagccgcggtaatacgtagggtgcgagcgttgtccggaattattgggcgtaaagagcttgtaggcggtttgtcgcgtctgctgtgaaagaccggggcttaactccggttctgcagtgggtacgggcagactagagtatggtaggggagactggaattcctggtgtagcggtgaaatgcgcagatatcaggaggaacaccgatggcgaaggcaggtctctgggccattactgacgctgagaagcgaaagcatggggagcgaacaggattagataccctggtagtccatgccgtaaacgttgggcgctaggtgtggggctcattccacgagttccgtgccgcagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaatcatgcagagatgtgtgcgtcttcggactggtgtacaggtggtgcatggttgtcgtcagctcgtgtcgtgagatgttgggttaagtcccgcaacgagcgcaaccctcgttccatgttgccagcacgtgatggtggggactcatgggagactgccggggtcaactcggaggaaggtggggatgacgtcaaatcatcatgccccttatgtcttgggcttcacgcatgctacaatggccggtacagagggttgcgaaactgtgaggtggagctaatcccaaaaaaccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcgaaggtgggactggcgattgggactaagtcgtaacaaggtagccgtaccggaaggtgcggctggatcacctcctttctaagga

SEQ ID NO: 3142 - DNA, 210 bp, Desemzia incerta
  ref <308>: DATABASE ACCESSION NUMBER: NCBI ACCESSION: NZ_FOXW01000013.1
  ref <309>: DATABASE ENTRY DATE: 2019-04-01
  ref <313>: RELEVANT RESIDUES IN SEQ ID NO: (1)..(210)
tttatatgagagtttgatcctggctcaggacgaacgctggcggcgtgcctaatacatgcaagtcgaacgcttcctaccggtgcttgcaccgggaaagaagagtggcggacgggtgagtaacacgtgggtaacctacctacaagcgggggataacattcggaaacggatgctaataccgcatagatctttttgtctcctggcagaaagaag

SEQ ID NO: 3143 - DNA, 1497 bp, Desertifilum sp. IPPAS B-1220
  ref <308>: DATABASE ACCESSION NUMBER: NCBI ACCESSION: NZ_MJGC01000009.1
  ref <309>: DATABASE ENTRY DATE: 2019-04-01
  ref <313>: RELEVANT RESIDUES IN SEQ ID NO: (1)..(1497)
tcacggagagtttgatcctggctcaggatgaacgctggcggtctgcttaacacatgcaagtcgaacggtgtcttcggacacagtggcggacgggtgagtaacgcgtgagaatctaccttcaggtcggggataacccctggaaacgggggctaataccggataggtcgaaagatgaaaggttaactgcctgaagaggagctcgcgtctgattagctagtaggtgtggtaagagcgcacctaggcgacgatcagtagctggtctgagaggatgagcagccacactgggactgagacacggcccagactcctacgggaggcagcagtggggaattttccgcaatgggcgaaagcctgacggagcaagaccgcgtgggggaggaaggcctttgggttgtaaaccccttttgttagggaagaaaaaaatgacggtacctaacgaatcagcctcggctaactccgtgccagcagccgcggtaatacggaggaggcaagcgttatccggaattattgggcgtaaagcgtccgtaggtggcccggcaagtctgctgtcaaagaccacagctcaactgtggaaaggcagtggaaactgcaaggctagagtgcggtaggggtagagggaattcccagtgtagcggtgaaatgcgtagagattgggaagaacaccggtggcgaaagcgctctactgggccgcaactgacactgatggacgaaagctaggggagcgaatgggattagataccccagtagtcctagctgtaaacgatggaaactaggtgtagcacgtatcgacccgtgctgtatcggagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaacctctgtgaaagcagagggtgccttcgggagccggaacacaggtggtgcatggctgtcgtcagctcgtgtcgtgagatgttgggttaagtcccgcaacgagcgcaaccctcgtccttagttgccagcattttggatgggcactctagggagactgccggtgacaaaccggaggaaggtggggatgacgtcaagtcagcatgccccttacgtcctgggcgacacacgtactacaatgctgtggacaaagagcagccaacccgcgagggcgagctaatctcataaaccacggctcagttcagatcgcaggctgcaactcgcctgcgtgaaggcggaatcgctagtaatcgccggtcagcatacggcggtgaatccgttcccgggccttgtacacaccgcccgtcacaccatgggagctggccacgcccgaagtcgttactccaaccgttcgcggaggaggacgccgaaggcagggctggtgactggggtgaagtcgtaacaaggtagccgtaccggaaggtgtggctggatcacctcctttatagggag

SEQ ID NO: 3144 - DNA, 1532 bp, Desertimonas flava
  ref <308>: DATABASE ACCESSION NUMBER: NCBI ACCESSION: NZ_QKYK01000032.1
  ref <309>: DATABASE ENTRY DATE: 2019-04-01
  ref <313>: RELEVANT RESIDUES IN SEQ ID NO: (1)..(1532)
ttgatggagagtttgatcctggctcaggacgaacgctggcggcgtgcttaatacatgcaagtcgaacgaggtccaacctttcgcaagattggggacgacctagtggcgaacgggtgcgtaacacgtgagaaacctgccccggtctctggaataacaagtggaaacacttgctaataccggatgccgtctgaccaccgcatggtggaccgacgaaagatttatcggatcgggagggtctcgcggcctatcagcttgttggcgaggtaacggctcaccaaggcttcgacgggtagctggtctgagaggatgatcagccacactgggactgagacacggcccagactcctacgggaggcagcagtagggaatcttgcacaatgggcgaaagcctgatgcagcaacgccgcgtgcgggaagaaggccctagggttgtaaaccgctttcagcagggaagaaaatgacggtacctgtagaagaaggtgcggccaactacgtgccagcagccgcggtgacacgtaggcaccaagcgttgtccggatttattgggcgtaaagagctcgtaggcggttcagtgagtcgggtgtgaaaactcagggcttaaccctgagacgccacccgatactgctgtgactagagtgtggtaggggagcggggaattcctggtgtagcggtgaaatgcgcagatatcaggaggaacaccagtggcgaaggcgccgctctgggccattactgacgctgaggagcgaaagcgtgggtagcaaacaggattagataccctggtagtccacgccgtaaacgttgggcactaggtgtgggtctcaaccaacgagatccgcgccgtcgctaacgcattaagtgccccgcctggggagtacggtcgcaagactaaaactcaaaggaattgacgggggcccgcacaagcagcggagcgtgttgcttaattcgatgttacgcgaagaaccttacctgggtttgacatgtagggaaaagctctggagacagggtgtcctaacgggccctacacaggtggtgcatggctgtcgtcagctcgtgtcgtgagatgttgggttaagtcccgcaacgagcgcaacccttatcctatgttgccagcgggtaatgccggggactcgtaggagactgccggggtcaactcggaggaaggtggggatgaagtcaagtcatcatgccccttatgcccagggctgcaaacacgctacaatggccggtacagagggctgcgatcccgcgagggtgagcgaatcccacaaagccggtctcagttcggattggagtctgcaactcgactccatgaagccggagttgctagtaatcccggatcagcacgccggggtgaatacgttcccgggccttgtacacaccgcccgtcacaccacgaaagttggcaacacccgaagccggtggcccaacccgcaagggggggagccgtcgaaggtggggtcggtgattggggtgaagtcgtaacaaggtagccgtaccggaaggtgcggctggatcacctcctttctaaggag

SEQ ID NO: 3145 - DNA, 1556 bp, Desmospora activa
  ref <308>: DATABASE ACCESSION NUMBER: NCBI ACCESSION: NZ_PZZP01000013.1
  ref <309>: DATABASE ENTRY DATE: 2019-04-01
  ref <313>: RELEVANT RESIDUES IN SEQ ID NO: (1)..(1556)
tttatggagagtttgatcctggctcaggacgaacgctggcggcgtgcctaatacatgcaagtcgagcggaccgatagagagcttgctctcttgaagtcagcggcgaacgggtgagtaacacgtgggcaacctgcccgcaagactgggataactccgggaaaccggggctaataccggatacgatcttccctcgcatgagagaagatggaaaggcggcatcacgctgtcacttgcggatgggcccgcggcgcattagctagttggtgaggtagtggctcaccaaggcgacgatgcgtagccgacctgagagggtgaccggccacactgggactgagacacggcccagactcctacgggaggcagcagtagggaattttcgtcaatgggcgcaagcctgaacgagcaacgccgcgtgagtgaggacggctttcgggttgtaaagctctgttcttcgggaagaacgacagaagggtgaataatccttttgtgtgacggtaccggagaagaaagccccggctaactacgtgccagcagccgcggtaatacgtagggggcaagcgttgtccggaattattgggcgtaaagcgcgcgcaggcggcctgttaagtcggatgtgaaagaccacggctcaaccgtgggggtgcatccgaaactggcgggcttgagtgcaggagaggggagtggaattcccggtgtagcggtggaatgcgtagagatcgggaggaacaccagtggcgaaggcggctctctggcctgtaactgacgctgaggcgcgaaagcgtggggagcaaacaggattagataccctggtagtccacgccgtaaacgatgagtgctaggtgttgggggtttcacgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccccttcagagatgaaggttcccttcggggcagcggagacaggtggtgcatggttgtcgtcagctcgtgtcgtgagatgttgggttcagtcccgcaacgagcgcaacccttatcgttagttgccagcacctcgggtgggcactctagcgagacagccggtgaaagccggaggaaggtggggatgaggtcaaatcatcatgccccttatgtcctgggcaacacacgtgctacaatggctggtacaacgggtcgcgaagccgcgaggtggagccaatcccaaaaaaccagtctcagttcggatcgcaggctgcaactcgcctgcgtgaagctggaatcgctagtaatcgcggatcagcatgccgcggtgaatacgttcccgggccttgtacacaccgcccgtcacaccacgagagtttgcaacacccgaagtcggtgagggaacccttttgggacccagccgccgaaggtggggcagatgattggggtgaagtcgtaacaaggtatccctaccggaaggtggggatggatcacctcctttcta

SEQ ID NO: 3146 - DNA, 1461 bp, Desmospora sp. 8437
  ref <308>: DATABASE ACCESSION NUMBER: NCBI ACCESSION: NZ_GL892036.1
  ref <309>: DATABASE ENTRY DATE: 2019-04-01
  ref <313>: RELEVANT RESIDUES IN SEQ ID NO: (1)..(1461)
agcggcggacgggtgagtaacacgtgggcaacctgcccgcaagaccgggataactccgggaaaccggggctaataccggatgatgcctcttcctgcatgggaggatgctgaaaggcggcctttggctgtcacttgcggatgggcccgcggcgcattagctggttggtgaggtaacggctcaccaaggcgacgatgcgtagccgacctgagagggtgatcggccacactgggactgagacacggcccagactcctacgggaggcagcagtagggaattttccgcaatgggcgcaagcctgacggagcaacgccgcgtgagtgaggacggctttcgggttgtaaaactctgttcttcgggaagaacggtcgaagggtgaacaatcctttggcgtgacggtaccggaggagaaagccccggctaactacgtgccagcagccgcggtaatacgtagggggcaagcgttgtccggaattattgggcgtaaagcgcgcgcaggcggcctgttaagtctggtgtgaaagaccacggctcaaccgtggggtggcatcagaaactggcgggcttgagtgcaggagaggagagtggaattcccggtgtagcggtggaatgcgtagagatcgggaggaacaccagtggcgaaggcgactctctggcctgtaactgacgctgaggcgcgaaagcgtggggagcgaacaggattagataccctggtagtccacgccgtaaacgatgagtgctaggtgttgggggtttccgccctctgtgccgaaggtaacccaataagcactccgcctggggagtacggccgcaaggctgaaactcaaaggaattgacgggggcccgcacaagcggtggagcatgtggtttaattcgaagcaacgcgaagaaccttaccagggcttgacatcccgctgaccggtgtagagatacaccttcccttcggggcagcggtgacaggtggtgcatggttgtcgtcagctcgtgtcgtgagatgttgggttcagtcccgcaacgagcgcaacccttgtcgtcagttgccagcacatgatggtgggcactctggcgagacagccggtgaaagccggaggaaggtggggatgacgtcaaatcatcatgccccttatgtcctgggctacacacgtgctacaatggccggtacaacgggcagcgaacccgtgagggggagccaatcccaaaaaaccggtctcagttcggatcgcaggctgcaactcgcctgcgtgaagctggaatcgctagtaatcgcggatcagcatgccgcggtgaatccgttcccgggccttgtacacaccgcccgtcacaccacgagagtctgcaacacccgaagtcggtgaggtaaccttcgggaaccagccgccgaaggtggggcagatgattggggtgaagtcgtaacaaggtatccctaccggaaggtggggatggatcacctcctttctacggag

SEQ ID NO: 3147 - DNA, 1557 bp, Desulfacinum hydrothermale
  ref <308>: DATABASE ACCESSION NUMBER: NCBI ACCESSION: NZ_FWXF01000026.1
  ref <309>: DATABASE ENTRY DATE: 2019-04-01
  ref <313>: RELEVANT RESIDUES IN SEQ ID NO: (1)..(1557)
ttcaactggagagtttgatcctggctcagaatgaacgctggcggcgtgcctaacacatgcaagtcgcacgagaaaggctaggtttcgacttggccgagtaaagtggcgcacgggtgagtaacgcgtgggtgacctaccctcgaatctgggataacttcgcgaaagcggggctaataccggatacgtcccttcggggagaaagccggcctctcgaagaagctggtgttcggggatgggcccgcgtcctatcagctggttggtggggtaatggcccaccaaggcgacgacgggtagctggtctgagaggatgatcagccacactggcactggaacacgggccagactcctacgggaggcagcagtgaggaattttgcgcaatgggagcaatcctgacgcagcaacgccgcgtgggtgaagaaggccttcgggtcgtaaagccctgtcaggagggaagaaactggcggagtcgaacagactctgtcactgacggtacctccagaggaagcaccggctaactccgtgccagcagccgcggtaatacggagggtgcgagcgttattcggaattactgggcgtaaagcgcgtgtaggcggtggggcaagtctggtgtgaaagcccggggctcaaccccggaagtgcattggaaactgcctcacttgagtaccggagaggaagggggaattcccggtgtagcggtgaaatgcgtagatatcgggaggaataccagtggcgaaggcgcccttctggacggttactgacgctgagacgcgaaagcgtggggagcaaacaggattagataccctggtagtccacgccgtaaacgatgggcactaggtgcagcgggtattgacccctgctgtgccgaagctaacgcgttaagtgccccgcctggggactacggccgcaaggctaaaactcaaaggaattgacgggggcccgcacaagcggtggagcatgtggtttaattcgaagcaacgcgaagaaccttacctgggcttgacatcccgggagccccctggaaacaggggggtgcccttcggggaacccggagacaggtgctgcatggctgtcgtcagctcgtgtcgtgagatgttgggttaagtcccgcaacgagcgcaacccctgcctctagttgccatcacttcgggtgggcactctagagggactgccggtgtcaaaccggaggaaggtggggacgacgtcaagtcctcatggcccttatgcccagggctacacacgtgctacaatgggcggtacaaagggcagcgaacctgcgagggggagcgaatcccaaaaagccgtcctcagttcggatcggagtctgcaactcgactccgtgaaggtggaatcgctagtaatcgcggatcagcatgccgcggtgaatacgttcccgggccttgtacacaccgcccgtcacaccacgaaagtcggctgtaccagaagtgcgtgggccaaccccttgtggggaggcagcgtaccaaggtgtggtcggtaattggggtgaagtcgtaacaaggtagccgtaggggaacctgcggctggatcacctcctttct

SEQ ID NO: 3148 - DNA, 717 bp, Desulfacinum infernum
  ref <308>: DATABASE ACCESSION NUMBER: NCBI ACCESSION: NZ_FQVB01000020.1
  ref <309>: DATABASE ENTRY DATE: 2019-04-01
  ref <313>: RELEVANT RESIDUES IN SEQ ID NO: (1)..(717)
ttcaactggagagtttgatcctggctcagaatgaacgctggcggcgtgcctaacacatgcaagtcgcacgagaaaggctgggtttcggcttggccgagtaaagtggcgcacgggtgagtaacgcgtgggtgacctaccctcgaatctgggataacctcgcgaaagcggggctaataccggatacgtcccttcggggggaaagccggcctctcgaagaagctggtgttcgaggatgggcccgcgtcctatcagcttgttggtagggtaacggcctaccaaggcgacgacgggtagctggtctgagaggatgatcagccacactggcactggaacacgggccagactcctacgggaggcagcagtgaggaattttgcgcaatgggagcaatcctgacgcagcaacgccgcgtgggtgaagaaggccttcgggtcgtaaagccctgtcaggagggaagaacctcgtctgggcgaacagcctggtcgactgacggtacctccagaggaagcaccggctaactccgtgccagcagccgcggtaatacggagggtgcgagcgttattcggaattactgggcgtaaagcgcgtgtaggcggcagggcaagtctggtgtgaaagcccggggctcaaccccggaagtgcattggaaactgctctgcttgagtaccggagaggaagggggaattcccggtgtagcggtgaaatgcgtagatatcggg

SEQ ID NO: 3149 - DNA, 1703 bp, Desulfallas gibsoniae
  ref <308>: DATABASE ACCESSION NUMBER: NCBI ACCESSION: NC_021184.1
  ref <309>: DATABASE ENTRY DATE: 2019-04-01
  ref <313>: RELEVANT RESIDUES IN SEQ ID NO: (1)..(1703)
ttttatggagagtttgatcctggctcaggacgaacgctggcggcgtgcttaacacatgcaagtcgaacggttctcgaagttcgaggttggatgttcgaagttcgaaaaaggaaagcaattcgaatctcgaacaccgaacctcgaacttcgaggatagtggcggacgggtgagtaacgcgtggataacctgcccaatagcctgggataacgccgggaaactggtgctaataccggatacgttcattgaactgcatagttcgatgaagaaaggtgcaaaccgctactggatgggtccgcgtcccattagctagttggtagggtaacggcctaccaaggcgacgatgggtagccggcctgagagggcgaccggccacactggaactgagacacggtccagactcctacgggaggcagcagtggggaatcttccgcaatgggcgcaagcctgacggagcaacgccgcgtgagtgacgaaggtcttcggattgtaaaactctgtccaaagggaagaagaaagtgacggtacctttggaggaagccccggctaactacgtgccagcagccgcggtaaaacgtagggggcaagcgttgtccggaattactgggcgtaaagggcgtgtaggcggctctacaagttagaagtgaaacctatcagctcaactgatagcctgcttctaaaactgtcgggcttgagtgcagtagaggggagtggaattcccagtgtagcggtgaaatgcgtagatattgggaggaacaccagtggcgaaagcggctccctggcctgtaactgacgctgaggcgcgaaagcgtgggtagcaaacaggattagataccctggtagtccacgccgtaaacgatgggtgctaggtgttgggggtatcgacccccccagtgccgcagttaacgcaataagcaccccgcctggggagtacggccgcaaggctgaaactcaaaggaattgacgggggcccgcacaagcggtggagtatgtggtttaattcgacgcaacgcgaagaaccttaccaggtcttgacatctcctgatcgtcatggaaacatgatctttcccttcggggaacaggaagacaggtggtgcatggttgtcgtcagctcgtgtcgtgagatgttgggttaagtcccgcaacgagcgcaacccctacctttagttgccagcatgtagagatgggcactctaaagggactgccgttgacaaaacggaggaaggtggggatgacgtcaaatcatcatgccctttatgatctgggctacacacgtactacaatggccggtacagacggaagcgcagccgtgaggtgaagcgaacccgaaaaagccggtcccagttcggattgcaggctgcaactcgcctgcatgaagtcggaatcgctagtaatcgcaggtcagcatactgcggtgaatacgttcccgggccttgtacacaccgcccgtcacaccacgaaagttggcaacacccgaagccggtgggctaacccttctcgaggttcgaggttcgaagttagaagttcgaaattggggaaagtttctgaggtcaaaaagaccccaaaggaatacccggatcgaatatcgaacatcgaatttcgaacctcgagaagagaagcagccgtcgaaggtggggtcggtaattggggtgaagtcgtaacaaggtagccgtatcggaaggtgcggctggatcacctcctttct

SEQ ID NO: 3150 - DNA, 1562 bp, Desulfarculus baarsii
  ref <308>: DATABASE ACCESSION NUMBER: NCBI ACCESSION: NC_014365.1
  ref <309>: DATABASE ENTRY DATE: 2019-04-01
  ref <313>: RELEVANT RESIDUES IN SEQ ID NO: (1)..(1562)
tttaactggagagtttgatcctggctcagaacgaacgctggcggcaggcctaacacatgcaagtcgcacgagaacgattcccttcggggagactagtaaagtggcgcacgggtgagtaacgcgtgggtaatctacctgatggtacggaataacgtctcgaaaggggcgctaataccgtataagaccacgacaactgcggttgttgcggtcaaagggggcctctctatagaagctcctgccattggacgagcccgcgtcccattagcttgttggtgaggtaacggctcaccaaggccgcgatgggtagctggtctgagaggatgatcagccacactgggactggaacacggcccagactcctacgggaggcagcagtgaggaatcttgcgcaatgggggaaaccctgacgcagccatgccgcgtgagtgaagaaggccttcgggtcgtaaagctctgtcaggtgggaagaaccctcaagggacgaataatcctttgagctgacggtaccgccaaaggaagcaccggctaactccgtgccagcagccgcggtaatacggagggtgcaagcgttgttcggaattactgggcgtaaagcgtgtgcaggcggccaaataagtcggatgtgaaagccctcggctcaaccgaggaactgcattcgatactgcttggcttgagtcctggagaggagagtggaattcccggtgtagaggtgaaattcgtagatatcgggaggaacatcggtggcgaaggcgactctctggacagtgactgacgctgatacacgaaagcgtggggagcaaacaggattagataccctggtagtccacgctgtaaacggtgtccactaggtgtagcgggtattgacccccgctgtgccgtagctaacgcgttaagtggaccgcctggggagtacggccgcaaggttaaaactcaaaggaattgacgggggcccgcacaagcggtggagcatgtggtttaattcgaagcaacgcgaagaaccttacctgggtttgacatccccggacagcctatgaaagtaggtttttcttcggaaccgggtgacaggtgctgcatggctgtcgtcagctcgtgtcgtgagatgttgggttaagtcccgcaacgagcgcaacccctatcgttagttgccagtatttagttaggcactctagtgatactgccccggttaacggggaggaaggtggggatgacgtcaagtcatcatggcccttatgcccagggctacacacgtgctacaatggtcggtacaaagggctgctaaatcgcgaggttatgccaatcccaaaaagccggcctcagttcggattggagtctgcaactcgactccatgaagttggaatcgctagtaatcccggatcagcatgccggggtgaatacgttcccgggccttgtacacaccgcccgtcacaccacgaaagccagctgtaccagaagtggctgggctaaccttcgggaggcaggtccccaaggtatggttggtaattggggtgaagtcgtaacaaggtagccgtaggggaacctgcggctggatcacctcctttcta

SEQ ID NO: 3151 - DNA, 1570 bp, Desulfatibacillum aliphaticivorans
  ref <308>: DATABASE ACCESSION NUMBER: NCBI ACCESSION: NZ_AUCT01000040.1
  ref <309>: DATABASE ENTRY DATE: 2019-04-01
  ref <313>: RELEVANT RESIDUES IN SEQ ID NO: (1)..(1570)
tttaattggagagtttgatcctggctcagaatgaacgctggcggcgtgcttaacacatgcaagtcgtacgagaactcccttgcttgcaagggatagtaaagtggcgcacgggtgagtaacgcgtgggtaatctacccttggattcgggataacattgcgaaagcggtgctaataccggataacattcgcaggtcttaggatgtgcggatcaaagatggcctctacatgtaagctatcgtctggggaggagctcgcgtaccattagctagttggtggggtaaaggcccaccaaggctccgatggttagctggtctgagaggatgatcagccacactggaactgacacacggtccagactcctacgggaggcagcagtgaggaatcttgcgcaatgggcgaaagcctgacgcagcaacgccgcgtgagtgatgaaggccttcgggtcgtaaagctctgtcaagtgggaagaacctgcttctgattaatactcaggagtactgacggtaccactgaaggaagcaccggctaactccgtgccagcagccgcggtaatacggagggtgcaagcgttattcggaattattgggcgtaaagggcgcgcaggcggccgtttaagtcagatgtgaaatcccggggcttaaccccggaagtgcatttgatactggatggcttgagtatgggagagggaagtggaattcctggtgtagaggtgaaattcgtagatatcaggaggaacaccggtggcgaaggcgacttcctggaccaatactgacgctgaggcgcgaaggcgtggggagcaaacaggattagataccctggtagtccacgcagtaaacgttgatcactaggtgtagcgggtattgacccctgctgtgccgcagctaacgcattaagtgatccgcctggggagtacggccgcaaggttaaaactcaaaggaattgacgggggcccgcacaagcggtggagcatgtggtttaattcgacgcaacgcgcaaaaccttacctggatttgacatctcgggaatctctttgaaagaagagagtgcccttcggggagcccgatgacaggtgctgcatggctgtcgtcagctcgtgtcgtgagatgttgggttaagtcccgcaacgagcgcaacccctatgtttagttgccatcattcagttgggcactctaaatagactgccccggttaacggggaggaaggtggggatgacgtcaagtcctcatggcccttatgtccagggctacacacgtgctacaatggatcgcacaaagggcagcgaactcgcgagagtaagccaatcccaaaaaacggtcctcagttcggattggagtctgcaactcgactccatgaagttggaatcgctagtaatcgcggatcagcatgccgcggtgaatacgttcccgggccttgtacacaccgcccgtcacaccatgagagttggctgtaccagaagtcgtcgggctaaccttcgggaggcaggcgcctaaggtatggttgataattggggtgaagtcgtaacaaggtagccgttggggaaccagcggctggatcacctcctttctaagga

SEQ ID NO: 3152 - DNA, 1570 bp, Desulfatibacillum alkenivorans
  ref <308>: DATABASE ACCESSION NUMBER: NCBI ACCESSION: NZ_FQZU01000008.1
  ref <309>: DATABASE ENTRY DATE: 2019-04-01
  ref <313>: RELEVANT RESIDUES IN SEQ ID NO: (1)..(1570)
tttaattggagagtttgatcctggctcagaatgaacgctggcggcgtgcttaacacatgcaagtcgtacgagaactcccttgcttgcaagggatagtaaagtggcgcacgggtgagtaacgcgtgggtaatctacccttggattcgggataacattgcgaaagcggtgctaataccggataatattcgcatgtcttaggatgtgcggatcaaagatggcctctacatgtaagctattgtctgaggaggagctcgcgtaccattagctagttggtggggtaaaggcccaccaaggctccgatggttagctggtctgagaggatgatcagccacactggaactgacacacggtccagactcctacgggaggcagcagtgaggaatcttgcgcaatgggcgaaagcctgacgcagcaacgccgcgtgagtgatgaaggccttcgggtcgtaaagctctgtcaagtgggaagaacctgcttctgattaatactcaggagtactgacggtaccactgaaggaagcaccggctaactccgtgccagcagccgcggtaatacggagggtgcaagcgttattcggaattattgggcgtaaagggcgcgcaggcggccgtttaagtcagatgtgaaatcccggggcttaaccccggaagtgcatttgatactggatggcttgagtatgggagagggaagtggaattcctggtgtagaggtgaaattcgtagatatcaggaggaacaccggtggcgaaggcgacttcctggaccaatactgacgctgaggcgcgaaggcgtggggagcaaacaggattagataccctggtagtccacgcagtaaacgttgatcactaggtgtagcgggtattgacccctgctgtgccgcagctaacgcattaagtgatccgcctggggagtacggccgcaaggttaaaactcaaaggaattgacgggggcccgcacaagcggtggagcatgtggtttaattcgacgcaacgcgcaaaaccttacctggatttgacatctcgggaatctctttgaaagaagagagtgcccttcggggagcccgatgacaggtgctgcatggctgtcgtcagctcgtgtcgtgagatgttgggttaagtcccgcaacgagcgcaacccctatgtttagttgccatcattgagttgggcactctaaatagactgccccggttaacggggaggaaggtggggatgacgtcaagtcctcatggcccttatgtccagggctacacacgtgctacaatggatcgcacaaagggcagcgaactcgcgagagtaagccaatcccaaaaaacggtcctcagttcggattggagtctgcaactcgactccatgaagttggaatcgctagtaatcgcggatcagcatgccgcggtgaatacgttcccgggccttgtacacaccgcccgtcacaccatgagagttggctgtaccagaagtcgtcgggctaaccttcgggaggcaggcgcctaaggtatggttgataattggggtgaagtcgtaacaaggtagccgttggggaaccagcggctggatcacctcctttctaagga

SEQ ID NO: 3153 - DNA, 1568 bp, Desulfatiglans anilini
  ref <308>: DATABASE ACCESSION NUMBER: NCBI ACCESSION: NZ_AULM01000006.1
  ref <309>: DATABASE ENTRY DATE: 2019-04-01
  ref <313>: RELEVANT RESIDUES IN SEQ ID NO: (1)..(1568)
aagtggagagtttgatcctggctcagaacgaacgctggcggcgtgcctaacacatgcaagtcgaacgagaaattccggcttcggctggaagagtaaagtggcgcacgggtgagtaacgcgtgggtaacctgcccttgaatctgggataactccgcgaaagcggtgctaataccggatatcgtccctttgactttggtcattgtgatgaaaggtgacctcttcatgaaagttgccgtttaaggaggggcccgcgtaccattagctagttggtgaggtaacggctcaccaaggccgcgatggttagctggtctgagaggatgatcagccacactggaactggaacacggtccagactcctacgggaggcagcagtgaggaattttgcgcaatgggggaaaccctgacgcagcaacgccgcgtgagtgaagaaggccttcgggtcgtaaagctctgtcaagtgggaaaaaatcttcatcgtaaacagcgctgaagactgatggtaccactaaaggaagcaccggctaactccgtgccagcagccgcggtaatacggagggtgctagcgttgttcggaattactgggcgtaaagggcgtgtaggcggtttggcaagtcaggcgtgaaagcccagggctcaaccctggaagtgcgtttgaaactgccattctggagtatgggagaggagagtggaattcccagtgtagaggtgaaattcgtagatattgggaggaacacccgtggcgaaggcgactctctggaccaatactgacgctgagacgcgaaagcgtggggagcaaacaggattagataccctggtagtccacgcggtaaacgatgagaactaggtgtagcgggtattgacccctgctgtgccgtagctaacgcattaagttctccgcctggggagtacggccgcaaggctaaaactcaaaggaattgacgggggcccgcacaagcggtggagcatgtggtttaattcgacgcaacgcgaagaaccttacctgggtttgacatcctttgaccgccatggaaacatggttttcccgactctgtcgggacagagtgacaggtgctgcatggctgtcgtcagctcgtgtcgtgagatgttgggttaagtcccgcaacgagcgcaacccttgtctttagttgccagtattaagttaggcactctaaagagactgcctcggttaacgaggaggaaggtggggatgacgtcaagtcctcatggcctttatacccagggctacacacgtgctacaatgggctgtacaaagggtcgctatcccgcgagggggagctaatcccaaaaagcagttctcagttcggattggagtctgcaactcgacttcatgaagtcggaatcgctagtaatcgtggatcagcatgccacggtgaatacgttcccgggccttgtacacaccgcccgtcacaccacgaaagtcgattgtaccagaagttgctgggctaacccttcggggaggcaggtacctaaggtacggttggtaattggggtgaagtcgtaacaaggtagccgtaggggaacctgcggctggatcacctcctttctaa

SEQ ID NO: 3154 - DNA, 1578 bp, Desulfatirhabdium butyrativorans
  ref <308>: DATABASE ACCESSION NUMBER: NCBI ACCESSION: NZ_AUCU01000039.1
  ref <309>: DATABASE ENTRY DATE: 2019-04-01
  ref <313>: RELEVANT RESIDUES IN SEQ ID NO: (1)..(1578)
ttttggagagtttgatcctggctcagaatgaacgctggcggcgtgcttaacacatgcaagtcgtacgagaaatcttctgcttgcaggggagagtaaagtggcgtacgggtgagtaatgcgtgggtaatctacccttgaattcgggataacatatcgaaaggtgtgctaataccggatgaagtccatagggctgcggttttatggatgaaaggtggcctctacatgtaagctactgtttggggatgagcctacgtaccattagctagttggtagggtaaaggcctaccaaggcgacgatggttagctggtctgagaggatgatcagccacactggaactggaacacggtccagactcctacgggaggcagcagtgaggaattttgcgcaatgggggcaaccctgacgcagcaacgccgcgtgagtgaagaaggctttcgggtcgtaaagctctgtcgaagcgggaagaaggtgggctatttgaacaggatagtctattgacggtaccgcagaaggaagcaccggctaactccgtgccagcagccgcggtaatacggggggtgcaagcgttattcggaattattgggcgtaaagggcgcgtaggcggttgaataagtcagatgtgaaagcccttggcttaaccaaggaagtgcatttgatactatttgacttgagtatgggagagggaagtggaattcctggtgtagaggtgaaattcgtagatatcaggaggaacaccggtggcgaaagcgacttcctggaccaatactgacgctgaggcgcgaaggcgtggggagcaaacaggattagataccctggtagtccacgcagtaaacggtgatcactaggtgtagcgggtattgacccctgctgtgccgcagttaacacattaagtgatccgcctggggagtacgatcgcaaggttaaaactcaaaggaattgacgggggcccgcacaagcggtggagcatgtggtttaattcgacgcaacgcgaagaaccttacctgggtttgacatctcgggaatctttatgaaagtagggagtgccccgcgaggggagcccgaagacaggtgctgcatggctgtcgtcagctcgtgtcgtgagatgttgggttaagtcccgcaacgagcgcaacccttatcttcagttaccatcattgagttggggactctggagatactgccccggttaacggggaggaaggtggggatgacgtcaagtcctcatggcctttatatccagggctacacacgtgctacaatggtccgtacaaagggtagcgagcctgcgagggtaagccaatcccggaaagcggatctcagttcggattggagtctgcaactcgactccatgaagttggaatcgctagtaatcgtggatcagcatgccacggtgaatacgttcccgggccttgtacacaccgcccgtcacaccatgagagttggttgtaccagaagtcgtcggaccaaccccgccttggcgggggggtaggcgcctaaggtatggctgatgattggggtgaagtcgtaacaaggtagccgttggggaaccagcggctggatcacctcctttctaagga

SEQ ID NO: 3155 - DNA, 1568 bp, Desulfatitalea tepidiphila
  ref <308>: DATABASE ACCESSION NUMBER: NCBI ACCESSION: NZ_BCAG01000003.1
  ref <309>: DATABASE ENTRY DATE: 2019-04-01
  ref <313>: RELEVANT RESIDUES IN SEQ ID NO: (1)..(1568)
tttaattggagagtttgatcctggctcagagtgaacgctggcggcgtgcttaacacatgcaagtcgcacgagaacgcttctgcttgcagaggctagtaaagtggcgcacgggtgagtaacacgtgggtaatctacctccgaattggggataacgttgcgaaagcgacgctaataccgaatgacatctttgttgcctcggtaataaagatcaaaggtggcctcttcatgaaagctactgtttggagatgagcccgcgtcccattagctcgttggtagggtaatggcctaccaaggctacgatgggtagctggtctgagaggatgatcagccacactggaactgacacacggtccagactcctacgggaggcagcagtgaggaattttgcgcaatgggggaaaccctgacgcagcaacgccgcgtgagtgatgaaggccttcgggtcgtaaagctctgtcaagtgggaagaacccgtatcttgttaatatctggatacgctgacggtaccactgaaggaagcaccggctaactccgtgccagcagccgcggtaatacggggggtgcaagcgttactcggaatcattgggcgtaaagggcgcgtaggcggcttggtcagtcaggtgtgaaagcccggggctcaaccccggaagtgcatttgatactacctagcttgagtatgggagagggaagtggaattcctggtgtagaggtgaaattcgtagatatcaggaggaacacctgtggcgaaggcgacttcctggaccaatactgacgctgaggcgcgaaggcgtggggagcaaacaggattagataccctggtagtccacgcagtaaacgttgttcactaggtgtagcgggtattgacccctgctgtgccgaagctaacgcattaagtgaaccgcctgggaagtacggccgcaaggttaaaactcaaaggaattgacgggggcccgcacaagcggtggagcatgtggtttaattcgacgcaacgcgaagaaccttacctgggtttgacatctccggaatctttatgaaagtagagagtgcccttcggggagccggaagacaggtgctgcatggctgtcgtcagctcgtgtcgtgagatgttgggttaagtcccgcaacgagcgcaacccctatctttagttaccagcgattcggtcggggactctaaagatactgccccggttaacggggaggaaggtggggatgacgtcaagtcctcatggcctttatgcccagggctacacacgtgctacaatgggcggtacaaagggtagcgatcccgcgaggaggagccaatcccaaaaaaccgtcccaagttcggattggagtctgcaactcgactccatgaagttggaatcgctagtaatcgcggatcagcatgccgcggtgaatacgttcccgggccttgtacacaccgcccgtcacaccatgagagttggttgtaccagaagttgtcgggcaaacccttcgggggtgcaggcacctaaggtatggctgatgattggggtgaagtcgtaacaaggtagccgttggggaaccagcggctggatcacctcctttct

SEQ ID NO: 3156 - DNA, 1805 bp, Desulfitibacter alkalitolerans
  ref <308>: DATABASE ACCESSION NUMBER: NCBI ACCESSION: NZ_KK211101.1
  ref <309>: DATABASE ENTRY DATE: 2019-04-01
  ref <313>: RELEVANT RESIDUES IN SEQ ID NO: (1)..(1805)
tggagagtttgatcctggctcaggacgaacgctggcggcgtgcttaacacatgcaagtcgaacggagcggaggtcagtcgtcagaggtcagaagtctgcaatagaagcaattggcaagccaattgcagacaagagcggacatcggacttccgatgactgacttccaatcagtggcggacgggtgagtaacgcgtgggtaacctaccctttaagctgggataactccgggaaactggagctaataccggataagcttacagtatggcatcatacagtaagaaaaggaggcctctggaataagcttccgataaaggatggacccgcgtcccattagctagttggtgaggtagaggctcaccaaggcgacgatgggtagccggcctgagagggtggacggccacactgggactgagacacggcccagactcctacgggaggcagcagtggggaatattgcgcaatgggggaaaccctgacgcagcaacgccgcgtgagtgaagaaggccttcgggtcgtaaagctctgtcaatggggaagaagtcttatttttgaatagggaataaggtgacggtacccaaggaggaagccacggctaactacgtgccagcagccgcggtaatacgtaggtggcaagcgttgtccggaattactgggcgtaaagggcgtgtaggtggtcaaacaagtcaggtgtgaaaccccggggcttaacttcgggcatgcatttgaaactgtatgacttgagggcaagagaggaaagtggaattcctagtgtagcggtgaaatgcgtagatattaggaggaacaccagtggcgaaggcgactttctggattgaccctgacactgaggcgcgaaagcgtggggagcaaacaggattagataccctggtagtccacgccgtaaacgatgggtactaggtgttggaggtatcgaccccttcagtgccgcagcaaacgcattaagtaccccgcctggggagtacggccgcaaggctgaaactcaaaggaattgacgggggcccgcacaagcggtggagcatgtggtttaattcgacgcaacgcgaagaaccttaccagggcttgacatcctctgacgtccatagagatatggagttttcttcggaaacagagagacaggtggtgcatggttgtcgtcagctcgtgtcgtgagatgttgggttaagtcccgcaacgagcgcaacccctgtacttagttgccagcaataagatgggcactctaagtagactgccggtgacaaaccggaggaaggtggggatgacgtcaaatcatcatgccccttatgtcctgggctacacacgtgctacaatggtcggtacagagggcagcgagaccgtgaggtggagcaaatcccaaaaagccgatcacagttcggattgtaggctgaaactcgcctacatgaagtcggaatcgctagtaatcgcaggtcagcatactgcggtgaatacgttcccgggccttgtacacaccgcccgtcacaccacgaaagctggcaacacccgaagccggtgagctaactcgttcggaggtcagaggtcagaagtcagaagtctaaacagaagtcagaggacagaagtccgaggtcagaaatagaagcaattggctaagccgattgcaacaagaactgacagcagacaatggatacttgacaactgaacagacaaccgacatccgatttccgacttccgaatgaggggcagccgtctaaggtggggctagtgattggggtgaagtcgtaacaaggtagccgtatcggaaggtgcggctggatcacctcctttctaaggag

SEQ ID NO: 3157 - DNA, 1476 bp, Desulfitobacterium chlororespirans
  ref <308>: DATABASE ACCESSION NUMBER: NCBI ACCESSION: NZ_FRDN01000001.1
  ref <309>: DATABASE ENTRY DATE: 2019-04-01
  ref <313>: RELEVANT RESIDUES IN SEQ ID NO: (1)..(1476)
tagtggcggacgggtgagtaacgcgtggataacctacctagtagaccgggacaacccttggaaacgagggctaataccggataagcttacgccttggcatcaaggagtaaggaaagatggcctctgaagatgctatcgttagtagatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggtatttgtgtaaataatgcagatacatgacggtacctgaggaggaagccccggctaactacgtgccagcagccgcggtaatacgtagggggcaagcgttgtccggaatcattgggcgtaaagggcgcgtaggcggatacttaagtctggtgtgaaaacctagggctcaaccctgggactgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatctcgtggaaacatgagagtgcccttcggggagctatgagacaggtggtgcatggttgtcgtcagctcgtgtcgtgagatgttgggttaagtcccgcaacgagcgcaacccctatgtttagttgctaacaggtaaggctgagcactctagacagactgccggtgacaaaccggaggaaggtggggatgacgtcaaatcatcatgccccttatgtcttgggctacacacgtgctacaatggccagtacagacggaagcgaagccgtgaggtgaagccaatccgagaaagctggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgataattggggtgaagtcgtaacaaggtagccgtatcggaaggtgcggctggatcacctcctttctaaggaga

SEQ ID NO: 3158 - DNA, 1692 bp, Desulfitobacterium dehalogenans
  ref <308>: DATABASE ACCESSION NUMBER: NCBI ACCESSION: NC_018017.1
  ref <309>: DATABASE ENTRY DATE: 2019-04-01
  ref <313>: RELEVANT RESIDUES IN SEQ ID NO: (1)..(1692)
ttttatggagagtttgatcctggctcaggacgaacgctggcggcgtgcctaacacatgcaagtcgaacggactaacgtttagcactgagtgttcagtgaagttggttaaagcgagagctcgaacgtagtggaacgaagagagagctccacgcattataaagtgccaacacagtttattagaaagaacatgaagaacactgagtgctagacgttagttagtggcggacgggtgagtaacgcgtggataacctacccaatagaccgggacaacccttggaaacgagggctaataccggataagcttatctcatggcatcatgggataaggaaagatggcctctgaacatgctatcgttaatggatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggcaggtatgaaaatattgtacttgcatgacggtacctgaggaggaagccccggctaactacgtgccagcagccgcggtaatacgtagggggcaagcgttgtccggaatcattgggcgtaaagggcgcgtaggcggatgattaagtctggtgtgaaaacctagggctcaaccctgggactgcatcggaaactggttatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccctctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatcccgtggaaacatgggagtgcccttcggggagctatgagacaggtggtgcatggttgtcgtcagctcgtgtcgtgagatgttgggttaagtcccgcaacgagcgcaacccctatgtttagttgccagcaagtaaggttgggcactctagacagactgccggtgacaaaccggaggaaggtggggatgacgtcaaatcatcatgccccttatgtcttgggctacacacgtgctacaatggccagtacagacggaagcgaagccgtgaggtggagcaaatccgagaaagctggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccttttgggagctagccgtcgaaggtggggccgatgattggggtgaagtcgtaacaaggtagccgtatcggaaggtgcggctggatcacctcctttctaaggaga

SEQ ID NO: 3159 - DNA, 1743 bp, Desulfitobacterium dichloroeliminans
  ref <308>: DATABASE ACCESSION NUMBER: NCBI ACCESSION: NC_019903.1
  ref <309>: DATABASE ENTRY DATE: 2019-04-01
  ref <313>: RELEVANT RESIDUES IN SEQ ID NO: (1)..(1743)
ttttatggagagtttgatcctggctcaggacgaacgctggcggcgtgcctaacacatgcaagtcgaacggactagcgtttagcactgagtgttcagtgatgttggataaagcgagagctctaaacaaaactctgattgtgcaaagcagaatcagtagttgcgttatccctggcaagggggaacgtagcgaagcgaagagagagctccacgcaatatagagtaccaacacagtggattagaaaagaacactgagtgctagacgttagttagtggcggacgggtgagtaacgcgtggataacctacccattagaccgggacaacccttggaaacgagggctaataccggataagaatatttcgtggcatcacgagataaggaaagatggcctctgaatatgctatcgttaatggatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggtatttatgtaaataatgtagatacatgacggtacctgaggaggaagccccggctaactacgtgccagcagccgcggtaatacgtagggggcaagcgttgtccggaatcattgggcgtaaagggcgcgtaggcggataattaagtctggtgtgaaaacctagggctcaaccctgggactgcatcggaaactggttatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggattatgtggtttaattcgacgcaacgcgaagaaccttaccaaggcttgacatcctacgaatcctgaggaaacttaggagtgcccttcggggagcgtagagacaggtggtgcatggttgtcgtcagctcgtgtcgtgagatgttgggttaagtcccgcaacgagcgcaacccctatgtttagttgctaacgagtaaggtcgagcactctagacagactgccggtgacaaaccggaggaaggtggggatgacgtcaaatcatcatgccccttatgtcttgggctacacacgtaatacaatggccggtacagacggaagcgaagccgtgaggtgaagcgaatccgagaaagccggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgatgattggggtgaagtcgtaacaaggtagccgtatcggaaggtgcggctggatcacctcctttctaaggaga

SEQ ID NO: 3160 - DNA, 541 bp, Desulfitobacterium hafniense
  ref <308>: DATABASE ACCESSION NUMBER: NCBI ACCESSION: NZ_LOCK01000092.1
  ref <309>: DATABASE ENTRY DATE: 2019-04-01
  ref <313>: RELEVANT RESIDUES IN SEQ ID NO: (1)..(541)
aatgtacttacatgacggtacctgaggaggaagccccggctaactacgtgccagcagccgcggtaatacgtagggggcaagcgttgtccggaatcattgggcgtaaagggcgcgtaggcggatacttaagtctggtgtgaaaacctagggctcaaccctgggactgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatc

SEQ ID NO: 3161 - DNA, 1577 bp, Desulfitobacterium metallireducens
  ref <308>: DATABASE ACCESSION NUMBER: NCBI ACCESSION: NZ_CP007032.1
  ref <309>: DATABASE ENTRY DATE: 2019-04-01
  ref <313>: RELEVANT RESIDUES IN SEQ ID NO: (1)..(1577)
ttttatggagagtttgatcctggctcaggacgaacgctggcggcgtgcctaacacatgcaagtcgaacggagaactcaataagcttgcttagcgagttttagtggcggacgggtgagtaacgcgtgggtaacctacccattaaatcgggacaacccttggaaacgagggctaataccggatacgtttaactgatggcatcatcggttaaagaaagatggcctctgaacatgctatcgataatggatggacccgcgtctgattagctagttggtggggtaaaggcctaccaaggcgacgatcagtagccggcctgagagggtgaacggccacactgggactgagacacggcccaggctcctacgggaggcagcagtggggaatcttccgcaatggacgaaagtctgacggagcaacgccgcgtgtatgatgaaggccttcgggttgtaaagtactgttttcagggacgaacggtagatatgcaaatagtgtatttacatgacggtacctgaggaggaagccccggctaactacgtgccagcagccgcggtaatacgtagggggcaagcgttgtccggaatcattgggcgtaaagggcgcgtaggcggataattaagtctggtgtgaaaacttggggctcaaccccaagcctgcatcggaaactggttatcttgaggacaggagaggaaagtggaacttccacgtgtagcggtgaaatgcgtagagatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctacgaattcttaggaaactaaggagtgcccttcggggaacgtagagacaggtggtgcatggttgtcgtcagctcgtgtcgtgagatgttgggttaagtcccgcaacgagcgcaacccctatgtttagttgctaacgagtaaggtcgagcactctagacagactgccggtgataaaccggaggaaggtggggatgacgtcaaatcatcatgccccttatgtcttgggctacacacgtgctacaatggccggtacagacggaagcgaagccgcgaggtggagcaaatccgagaaagccggtctcagttcggattgttctctgcaactcgagaacatgaagttggaatcgctagtaatcgcaggtcagcatactgcggtgaatacgttcccgggccttgtacacaccgcccgtcacaccacgaaagtctgcaacaccccgaagccggtgaggtaacccgaaagggagctagccgtcgaaggtggggccgatgattggggtgaagtcgtaacaaggtagccgtatcggaaggtgcggctggatcacctcctttctaaggaga

SEQ ID NO: 3162 - DNA, 1691 bp, Desulfitobacterium sp. PCE1
  misc_feature (589)..(589): n is a, c, g, or t
  misc_feature (591)..(592): n is a, c, g, or t
  misc_feature (597)..(597): n is a, c, g, or t
  misc_feature (603)..(603): n is a, c, g, or t
  misc_feature (608)..(609): n is a, c, g, or t
  misc_feature (611)..(611): n is a, c, g, or t
  ref <308>: DATABASE ACCESSION NUMBER: NCBI ACCESSION: NZ_KB913023.1
  ref <309>: DATABASE ENTRY DATE: 2019-04-01
  ref <313>: RELEVANT RESIDUES IN SEQ ID NO: (1)..(1691)
ttttatggagagtttgatcctggctcaggacgaacgctggcggcgtgcctaacacatgcaagtcgaacggactaattcttaacactgagttcttagtaaggagccagcgagagcgcgaacgtagtgaaacgaagtgagcgctccacgcattataaagtgccaacacacttatctaaggagaacttcggactaagggttgagtgttaagaattagttagtggcggacgggtgagtaacgcgtggataacctacccaatagaccgggacaacccttggaaacgagggctaataccggataagcttatcccatggcatcatgggataaggaaagatggcctctgaatatgctatcgttaatggatggatccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtacgacgaaggccttcgggttgtaaagtactgtcttcagggacgaacggnanntatgnaaatantgtanntncatgacggtacctgaggaggaagccccggctaactacgtgccagcagccgcggtaatacgtagggggcaagcgttgtccggaatcattgggcgtaaagggcgcgtaggcggatgattaagtctggtgtgaaaacctagggctcaaccctgggactgcatcggaaactggttatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccctctgtgccgcagttaacacactaagcactccgcctggggagtacggccgcaaggttgaaactcaaaggaattgacgggggcccgcacaagcggtggagcatgtggtttaattcgacgcaacgcgaagaaccttaccaaggcttgacatccatagaatcccgtggaaacatgggagtgcccttcggggagctatgagacaggtggtgcatggttgtcgtcagctcgtgtcgtgagatgttgggttaagtcccgcaacgagcgcaacccctatgtttagttgccagcaagtaatgttgggcactctagacagactgccggtgacaaaccggaggaaggtggggatgacgtcaaatcatcatgccccttatgtcttgggctacacacgtgctacaatggccagtacagacggaagcgaagccgtgaggtggagcaaatccgagaaagctggtctcagttcggattgttctctgcaactcgagaacatgaagtcggaatcgctagtaatcgcaggtcagcatactgcggtgaatacgttcccgggccttgtacacaccgcccgtcacaccacgaaagtctgcaacacccgaagccggtgaggtaacccttttgggagctagccgtcgaaggtggggccgatgattggggtgaagtcgtaacaaggtagccgtatcggaaggtgcggctggatcacctcctttctaaggaga

SEQ ID NO: 3163 - DNA, 1568 bp, Desulfobacca acetoxidans
  ref <308>: DATABASE ACCESSION NUMBER: NCBI ACCESSION: NC_015388.1
  ref <309>: DATABASE ENTRY DATE: 2019-04-01
  ref <313>: RELEVANT RESIDUES IN SEQ ID NO: (1)..(1568)
tttaactggagagtttgatcctggctcagaatgaacgctggcggcgtgcttaacacatgcaagtcgtacgagaaagcccggcttgccgggcaagtaaagtggcgcacgggtgagtaacgcgtgggtaatctaccttcgtttgggggataacctaccgaaaggtgggctaataccgcataacgtgatcgagctctggcttgatcgccaaaggtggcctctccatggaagctaccgagtgaagatgagcccgcgtcccattagctagttggtaaggtaaaagcttaccaaggcgacgatgggtagctggtctgagaggatggccagccacactggaactggaacacggtccagactcctacgggaggcagcagtgaggaatcttgcgcaatgggggcaaccctgacgcagcaacgccgcgtgggtgaagaaggccttcgggtcgtaaagctctgtcaagtgggaagaatagccttaaggggaatatccttggggtatgacggtaccactggaggaagcaccggctaactccgtgccagcagccgcggtaatacggagggtgcaagcgttattcggaattattgggcgtaaagggcgtgtaggcggccagataagtcagaggtgaaagcccggggctcaaccccggaagtgcctttgaaactgtttggcttgagtgcgggagaggaaagcggaattcccagtgtagaggtgaaattcgtagatattgggaggaacatcggtggcgaaggcggctttctggaccgacactgacgctgaggcgcgaaagcgtggggagcaaacaggattagataccctggtagtccacgctgtaaacgatgggcactaggtgtaggaggtttttaaccctcctgtgccgtagctaacgcattaagtgccccgcctggggagtacggccgcaaggttaaaactcaaaggaattgacgggggcccgcacaagcggtggagcatgtggtttaattcgacgcaacgcgaagaaccttacctgggcttgacatctgcggaacctcatggaaacatgggggtgcctggcaacaggagccgcaagacaggtgctgcatggctgtcgtcagctcgtgtcgtgagatgttgggttaagtcccgcaacgagcgcaacccttgtctttagttgccatcatttagttgggcactctaaagagactgccggtgttaaaccggaggaaggtggggacgacgtcaagtcctcatggcctttatgcccagggctacacacgtgctacaatgggcggtacaaagggtcgcaaacctgtgaaggggagctaatcccaaaaagccgtcctcagttcggatcggagtctgcaactcgactccgtgaagttggaatcgctagtaatcgtggatcagcatgccacggtgaatacgttcccgggccttgtacacaccgcccgtcacaccacgaaagcctgttgtaccagaagtcgctggcctaacccttcggggaaggaggcgcctaaggtatggccggtaattggggtgaagtcgtaacaaggtagccgtaggggaacctgcggctggatcacctcctttctaag

SEQ ID NO: 3164 - DNA, 247 bp, Desulfobacter curvatus
  ref <308>: DATABASE ACCESSION NUMBER: NCBI ACCESSION: NZ_KB892956.1
  ref <309>: DATABASE ENTRY DATE: 2019-04-01
  ref <313>: RELEVANT RESIDUES IN SEQ ID NO: (1)..(247)
taactggagagtttgatcctggctcagaatgaacgctggcggcgtgcttaacacatgcaagtcgaacgagaaagggattgcttgcaatcctgagtagagtggcgcacgggtgagtaacacgtagataatctgccttcaagcctgggataactattcgaaagggtagctaataccggataaagtcggtttacacaagtagattgatgaaagattgcctattcttgaaagcaattgtttggggatgagt

SEQ ID NO: 3165 - DNA, 1564 bp, Desulfobacter hydrogenophilus
  ref <308>: DATABASE ACCESSION NUMBER: NCBI ACCESSION: NZ_QLNI01000091.1
  ref <309>: DATABASE ENTRY DATE: 2019-04-01
  ref <313>: RELEVANT RESIDUES IN SEQ ID NO: (1)..(1564)
taactggagagtttgatcctggctcagaatgaacgctggcggcgtgcttaacacatgcaagtcgaacgagaaaaggattgcttgcaatcctgagtagagtggcgcacgggtgagtaacacgtagataatctgccttcaaacctggaataactattcgaaagggtagctaataccggataaagtcgatttacacaagtggattgatgaaagattgcctcttcttgaaagcaattgtttggggatgagtctgcggaccattagcttgttggtggggtaaaggcctaccaaggcagcgatggttagctggtctgagaggatgatcagccacactggaactggaacacggtccagactcctacgggaggcagcagtgaggaattttgcgcaatgggggcaaccctgacgcagcaacgccgcgtgagtgaagaaggcctttgggtcgtaaagctctgtcaactgggaagaaattagcttctattaatagtagttgctattgacggtaccagtggaggaagcgccggctaactccgtgccagcagccgcggtaacacggggggcgcaagcgttattcggaattattgggcgtaaagggcgcgcaggcggtcttgtccgtcaggtgtgaaagctcggggctcaaccccggaagtgcacttgaaacagcaagacttgaatacgggagaggagagaggaattcctggtgtagaggtgaaattcgtagatatcaggaggaacaccgatggcgaaggcatctctctggaccgatattgacgctgaggcgcgaaggcgtgggtagcgaacgggattagataccccggtagtccacgcagtaaacgttgtacactcggtgtggcggatattaaaatctgctgtgcctaagctaacgcattaagtgtaccgcctgggaagtacggtcgcaagactaaaactcaaaggaattgacgggggcccgcacaagcggtggagcatgtggtttaattcgacgcaacgcgaagaaccttacctgggtttgacatcctgtgaatattgtgtaattgcaatagtgccttcgggagcacagagacaggtgctgcatggctgtcgtcagctcgtgtcgtgagatgtttggttaagtccagcaacgagcgcaacccttatcgtcagttgccagcacataatggtgggaactctggcgagactgccccggtcaacggggaggaaggtggggatgacgtcaagtcctcatggcccttatacccagggctacacacgtgctacaatggtaggtacaaagggcagcgactctgcaaagggaagcgaatcccaaaagcctatctcagtccggattggggtctgcaactcgaccccatgaagttggaatcgctagtaatcgcggatcagcatgccgcggtgaatatgttcccgggccttgtacacaccgcccgtcacaccatggaagttgattatacccgacgtcgctgggctaactatttataggggcaggcgcctaaggtatggtcgataactggggtgaagtcgtaacaaggtagccgttgaggaatcagcggctggatcacctcctttcaaa

SEQ ID NO: 3166 - DNA, 1567 bp, Desulfobacter postgatei
  ref <308>: DATABASE ACCESSION NUMBER: NCBI ACCESSION: NZ_CM001488.1
  ref <309>: DATABASE ENTRY DATE: 2019-04-01
  ref <313>: RELEVANT RESIDUES IN SEQ ID NO: (1)..(1567)
gattataactggagagtttgatcctggctcagaatgaacgctggcggcgtgcttaacacatgcaagtcgaacgagaaagggattgcttgcaatcccgagtagagtggcgcacgggtgagtaacacgtagataatctgccttcaagcctgggataactattcgaaagggtagctaataccggataaagtcgatttacacaagtagattgatgaaagattgcctcttcttgaaagcaattgtttggagatgagtttgcgtaccattagcttgttggtggggtaaaggcctaccaaggcaacgatggttagctggtctgagaggatgatcagccacactggaactggaacacggtccagactcctacgggaggcagcagtgaggaattttgcgcaatgggggcaaccctgacgcagcaacgccgcgtgagtgaagaaggcctttgggtcgtaaagctctgtcaacagggaagaagttacaattgtttaacagatggttgtattgacggtacctgtggaggaagcgccggctaactccgtgccagcagccgcggtaacacggggggcgcaagcgttattcggaattattgggcgtaaagggcgcgcaggcggtcttgtccgtcaggtgtgaaaggctcggggctcaaccccggaagtgcacttgaaacagcaagacttgaatacgggagaggaaagcggaattcctggtgtagaggtgaaattcgtagatatcaggaggaacaccgatggcgaaggcagctttctggaccgatattgacgctgaggcgcgaaggcgtgggtagcaaacgggattagataccccggtagtccacgcagtaaacgttgtacactcggtgtagcgggtattaaaacctgctgtgcccaagctaacgcattaagtgtaccgcctgggaagtacggtcgcaagactaaaactcaaaggaattgacgggggcccgcacaagcggtggagcatgtggtttaattcgacgcaacgcgaagaaccttacctgggtttgacatcctgtgaatatcccgtaattgggatagtgccttcgggagcacagagacaggtgctgcatggctgtcgtcagctcgtgtcgtgagatgtttggttaagtccagcaacgagcgcaacccttatcgttagttgccagcatttaaagatgggaactctaacgagactgcccgggtcaaccgggaggaaggtggggatgacgtcaagtcctcatggcccttatatccagggctacacacgtgctacaatggtaggtacaaagggcagcgactccgcaaggggaagccaatcccaaaagcctatctcagtccggattggggtctgcaactcgaccccatgaagttggaatcgctagtaatcgcggatcagcatgccgcggtgaatatgttcccgggccttgtacacaccgcccgtcacaccatgggagttgattatacccgacgtcgctgggctaacttttagaggcaggcgcctaaggtatggtcgataactggggtgaagtcgtaacaaggtagccgttgaggaatcagcggctggatcacctcctttcaaa

SEQ ID NO: 3167 - DNA, 221 bp, Desulfobacter vibrioformis
  ref <308>: DATABASE ACCESSION NUMBER: NCBI ACCESSION: NZ_JQKJ01000002.1
  ref <309>: DATABASE ENTRY DATE: 2019-04-01
  ref <313>: RELEVANT RESIDUES IN SEQ ID NO: (1)..(221)
taactggagagtttgatcctggctcagaatgaacgctggcggcgtgcttaacacatgcaagtcgaacgagaaagggattgcttgcagtcctgagtagagtggcgcacgggtgagtaacacgtagataatctgtctccaagcctgggataactattcgaaagggtagctaataccggataaagttgattcacataagtggattaatgaaagattgcctcttc

SEQ ID NO: 3168 - DNA, 1567 bp, Desulfobacterium autotrophicum
  ref <308>: DATABASE ACCESSION NUMBER: NCBI ACCESSION: NC_012108.1
  ref <309>: DATABASE ENTRY DATE: 2019-04-01
  ref <313>: RELEVANT RESIDUES IN SEQ ID NO: (1)..(1567)
tttaactggagagtttgattctggctcagaatgaacgctggcggcgtgcttaacacatgcaagtcgaacgagaaagggattgcttgcaatcctgagtagagtggcgcacgggtgagtaacacgtggataatctacctttgaatccgggataactgttcgaaagaatcgctaataccggatgaagtcagtctttccttggaaggattgatgaaagacagcctcttcttgaaagctgttgtttgaagatgagtccgcgcaccattagttagttggtggggtaacggcctaccaagacattgatggttagctggtctgagaggatgatcagccacactggaactgacacacggtccagactcctacgggaggcagcagtgaggaattttgcgcaatgggggcaaccctgacgcagcaacgccgcgtgagtgaagaaggcctttgggtcgtaaaactctgtcaatggggaagaagttattgcatattaatagtatgtcgtattgacggtacccatgaaggaagcaccggctaactccgtgccagcagccgcggtaatacggggggtgcaagcgttattcggaattattgggcgtaaagggcacgcaggcggtcttgccagtcagatgtgaaagcccggggctcaaccctggaagtgcatttgaaactacaagacttgagtacggtagaggaaaggggaattcctggtgtagaggtgaaattcgtagatatcaggaggaacaccggtggcgaaggcgcctttctggaccgaaactgacgctgaggtgcgaaggcgtgggtagcgaacaggattagataccctggtagtccacgcagtaaacgttgtatactaggtgtagcgggtattgacccctgctgtgccggagctaacgcattaagtataccgcctgggaagtacggtcgcaagactaaaactcaaagaaattgacgggggcccgcacaagcggtggagcatgtggtttaattcgacgcaacgcgcagaaccttacccagacttgacatcctgagaatctgttagagatattagagtgccttcgggaactcagagacaggtgctgcatggctgtcgtcagctcgtgtcgtgagatgttcggttaagtccggcaacgagcgcaacccctatcttcagttgccagcacatcatggtgggaactctgaagagactgccccggttaacggggaggaaggtggggatgacgtcaagtcctcatggcccttatgtctggggctacacacgtgctacaatggtatgtacaacgggcagcgaacctgcgaaggtgagcgaatccctgaaagcatatcccagtccggattggagtctgcaactcgactccatgaagttggaatcgctagtaatcgtggatcagcatgccacggtgaatacgttcccgggccttgtacacaccgcccgtcacaccatgagagttgattgtacccgacgtcattgggccaacccttcgggggggcaggtgcctaaggtatggttgataattagggtgaagtcgtaacaaggtagccgttggggaaccagcggctggatcacctcctttct

SEQ ID NO: 3169 - DNA, 1569 bp, Desulfobacterium vacuolatum
  ref <308>: DATABASE ACCESSION NUMBER: NCBI ACCESSION: NZ_FWXY01000056.1
  ref <309>: DATABASE ENTRY DATE: 2019-04-01
  ref <313>: RELEVANT RESIDUES IN SEQ ID NO: (1)..(1569)
taactggagagtttgattctggctcagaatgaacgctggcggcgtgcttaacacatgcaagtcgaacgagaaagttcctgcttgcaggaacgagtagagtggcgcacgggtgagtaacacgtggataatctaccttcaaatcgggaataaccattcgaaaggatggctaatgccggataaagtcagatattctttgggatttttgatgaaagggagcctctgatataagcttttgtttgaagatgagtccgcgcaccattagtttgttggtggggtaacggcctaccaagactgtgatggttagctggtctgagaggatgatcagccacactggaactgacacacggtccagactcctacgggaggcagcagtgaggaattttgcgcaatgggggaaaccctgacgcagcaacgccgcgtgagtgaagaaggcccttgggtcgtaaagctctgtcaacagggaagaaattattatgctttaatagagtgtagtattgacggtacctgtgaaggaagcaccggctaactccgtgccagcagccgcggtaatacggggggtgcaagcgttattcggaattattgggcgtaaagggcacgcaggcggtcctgtcagtcagatgtgaaagcccggggctcaaccccggacgtgcatttgaaacagcaggacttgagtacgggagaggaaaggggaattcctggtgtagaggtgaaattcgtagatatcaggaggaacaccggtggcgaaggcgcctttctggaccgatactgacgctgaggtgcgaaggcgtgggtagcgaacgggattagataccccggtagtccacgcagtaaacgttgtatgctaggtgtagcgggtattgacccctgctgtgccgcagttaacacattaagcataccgcctggggagtacggtcgcaagactaaaactcaaagaaattgacgggggcccgcacaagcggtggagcatgtggtttaattcgacgcaacgcgaagaaccttacccagacttgacatcttgagaatcctttagaaatttaggagtgccttcgggagctcaaagacaggtgctgcatggctgtcgtcagctcgtgtcgtgagatgtttggttaagtccagcaacgagcgcaacccttgtcttcagttgccagcacataatggtgggaactctgaagagactgccccggttaacggggaggaaggtggggatgacgtcaagtcctcatggcccttatgtctggggctacacacgtgctacaatggtatgtacaacgggcagcaaggcagcgatgccaagcaaatcccttaaagcatatcccagtccggattggagtctgcaactcgactccatgaagttggaatcgctagtaatcgtggatcagcatgccacggtgaatacgttcccgggccttgtacacaccgcccgtcacaccatgagagttgattgtacccgacgtcactgggccaacccttcgggggggcaggtgcctaaggtatggttgataattagggtgaagtcgtaacaaggtagccgttggggaaccagcggctggatcacctcctttctaagga

SEQ ID NO: 3170 - DNA, 1569 bp, Desulfobacula toluolica
  ref <308>: DATABASE ACCESSION NUMBER: NCBI ACCESSION: NC_018645.1
  ref <309>: DATABASE ENTRY DATE: 2019-04-01
  ref <313>: RELEVANT RESIDUES IN SEQ ID NO: (1)..(1569)
gattataactggagagtttgatcctggctcagaatgaacgctggcggcgtgcttaacacatgcaagtcgaacgagaaagggattgcttgcaatcctgagtagagtggcgcacgggtgagtaacacgtagataatctaccttcaagcctgggataactgcccgaaaggacagctaataccggatgaagttggttcacacaagtgaattaatgaaagattgcctcttcttgaaagcaattgtttggagatgagtttgcggaccattagtttgttggtggggtaaaggcctaccaagactgcgatggttagctggtctgagaggatgatcagccacactggaactggtacacggtccagactcctacgggaggcagcagtgaggaattttgcgcaatgggggaaaccctgacgcagcaacgccgcgtgagtgaagaaggcccttgggtcgtaaagctctgtcgacagggaagaaattagagttttctaataggagattctattgacggtacctgtagaggaagcaccggctaactccgtgccagcagccgcggtaatacggggggtgcaagcgttattcggaattattgggcgtaaagggcgcgtaggcggtcttgtcggtcagatgtgaaagcccagggctcaaccctggacgtgcatttgaaacagcaagacttgagtacgggagaggaaagcggaattcctggtgtagaggtgaaattcgtagatatcaggaggaacaccgatggcgaaggcagctttctggaccgatactgacgctgaggcgcgaaggcgtgggtagcgaacaggattagataccctggtagtccacgcagtaaacgatgtacactaggtgtggcggatattaaaatctgctgtgcccaagctaacgcattaagtgtaccgcctggggagtacggtcgcaagactaaaactcaaaggaattgacgggggcccgcacaagcggtggagcatgtggtttaattcgacgcaacgcgaagaaccttacctgggtttgacatcctgtgaatatctaagagattagatagtgccttcgggagcacagagacaggtgctgcatggctgtcgtcagctcgtgtcgtgagatgtttggttaagtccagcaacgagcgcaacccttatcgttagttgccagcacataatggtgggaactctagcgagactgcccgggttaaccgggaggaaggcggggatgacgtcaagtcctcatggcccttatgtccagggctacacacgtgctacaatggtaaatacagagggcagcaagccggcaacggtaagcgaatccctaaagtttatctcagtccggattggagtctgcaactcgactccatgaagttggaatcgctagtaatcgcggatcagcatgccgcggtgaatatgttcccgggccttgtacacaccgcccgtcacaccatgagagttgattatacccgacgtcgttgggctaactatttatagaagcaggcgcctaaggtatggttgataattggggtgaagtcgtaacaaggtagccgttgaggaatcagcggctggatcacctcctttcaaa

SEQ ID NO: 3171 - DNA, 1561 bp, Desulfobulbus elongatus
  ref <308>: DATABASE ACCESSION NUMBER: NCBI ACCESSION: NZ_JHZB01000019.1
  ref <309>: DATABASE ENTRY DATE: 2019-04-01
  ref <313>: RELEVANT RESIDUES IN SEQ ID NO: (1)..(1561)
ttgaactggagagtttgatcctggctcagaacgaacgctggcggcgtgcttaacacatgcaagtcgaacgcgaacgggacttcggtcccaagtagagtggcgcacgggtgagtaacgcgtagataacctgtcttcatgtctggaataatacgccgaaaggggtactaataccggatattcttgtttttcataaggttgacaagaaaaggtggcctctgcatatgctactgcatgaagaggggtctgcgtaccattagctagtaggtggggtaagggcctacctaggcaacgatggttagcgggtctgagaggatgatccgccacactggcactggaacacgggccagactcctacgggaggcagcagtgaggaatattgcgcaatgggggcaaccctgacgcagcgacgccgcgtgagtgaggaaggccttcgggtcgtaaagctctgtcaagaggaaagaagtgcatagcggttaatacccgttgtgtttgacggtacctctaaaggaagcaccggctaactccgtgccagcagccgcggtaatacggagggtgcaagcgttgttcggaatcactgggcgtaaagggcgcgtaggcggtttgataagtcagatgtgaaagcccatggcttaactgtggaagtgcatttgaaactgtcagacttgagtaccagaggggaaagtggaattcccggtgtagaggtgaaattcgtagatatcgggaggaataccggtggcgaaggcgactttctggctggatactgacgctgaggcgcgaaagcgtggggagcaaacaggattagataccctggtagtccacgccgtaaacgatgtcaactagatgtagggggtgttgatcccctctgtgtcgcagctaacgcattaagttgaccgcctggggagtacggtcgcaagattaaaactcaaaggaattgacgggggcccgcacaagcggtggagtatgtggtttaattcgatgcaacgcgaagaaccttacctggtcttgacatcccgggaatccttaggaaactagggagtgccttcattcgaaggagcctggagacaggtgctgcatggctgtcgtcagctcgtgtcgtgagatgttgggttaagtcccgcaacgagcgcaacccttgcctttagttgccatcagttcggctgggcactctaaagggactgccggtgtcaaaccggaggaaggtggggatgacgtcaagtcctcatggcctttatgaccagggctacacacgtactacaatggccgatacaaagggcagcgacactgcgaagtggagccaatcccataaattcggtctcagtccggattggagtctgcaactcgactccatgaagttggaatcgctagtaatcgcggatcagcatgccgcggtgaatacgttcccgggccttgtacacaccgcccgtcacaccacgggagtcggttgtaccagaagcagttgagctaaccgcaagggggcaggctgccaaggtatggctggtaactggggtgaagtcgtaacaaggtagccctaggggaacctggggctggatcacctccttta

SEQ ID NO: 3172 - DNA, 201 bp, Desulfobulbus japonicus
  ref <308>: DATABASE ACCESSION NUMBER: NCBI ACCESSION: NZ_KE386993.1
  ref <309>: DATABASE ENTRY DATE: 2019-04-01
  ref <313>: RELEVANT RESIDUES IN SEQ ID NO: (1)..(201)
taaactggagagtttgatcctggctcagaacgaacgctggcggcgtgcttaacacatgcaagtcgaacgcgaaagagttcttcggaacttgagtagagtggcgcacgggtgagtaacgcgtagataacctacctccatgtttgggataaccagccgaaaggctgactaataccggatatgcttgcttttcataagttttgc

SEQ ID NO: 3173 - DNA, 1280 bp, Desulfobulbus mediterraneus
  ref <308>: DATABASE ACCESSION NUMBER: NCBI ACCESSION: NZ_AUCW01000075.1
  ref <309>: DATABASE ENTRY DATE: 2019-04-01
  ref <313>: RELEVANT RESIDUES IN SEQ ID NO: (1)..(1280)
tttaagctactgcatattgaggggtctgcgtaccattagctagttggtggggtaagagcctaccaaggcttcgatggttagcgggtctgagaggatgatccgtcacactggcactgaaacacgggccagactcctacgggaggcagcagtgaggaatattgcgcaatgggggaaaccctgacgcagcgacgccgcgtgagtgaggaaggccttcgggtcgtaaaactctgtcaagagggaagaaatgcataacggttaatacccgttatgtttgacggtacctctaaaggaagcaccggctaactccgtgccagcagccgcggtaatacggagggtgcaagcgttgttcggaattactgggcgtaaagggcgcgcaggcggcctgataagtcagatgtgaaagcccacggcttaaccgtggaagtgcatttgaaactgtcaggcttgagtatcagaggggaaagtggaattcctggtgtagaggtgaaattcgtagatatcaggaggaataccagtggcgaaggcgactttctggctgaatactgacgctgaggcgcgaaagcgtggggagcaaacaggattagataccctggtagtccacgccgtaaacgatgtcaactaggtgtagggggtgttgatcccttctgtgccgcagctaacgcattaagttgaccgcctggggagtacggtcgcaagattaaaactcaaaggaattgacgggggcccgcacaagcggtggagtatgtggtttaattcgatgcaacgcgaagaaccttacctggtcttgacatcccgggaatctcgtggaaacatgagagtgccttcattagaaggaacctggtgacaggtgctgcatggctgtcgtcagctcgtgtcgtgagatgttgggttaagtcccgcaacgagcgcaacccttgcctttagttgccagcagttcggctgggcactctaaagggactgccggtgtcaaaccggaggaaggtggggatgacgtcaagtcctcatggcctttatgaccagggctacacacgtactacaatggccggtacaaagggcagcgacactgcgaagtgaagcgaatcccataaaaccggtctcagtccggattggagtctgcaactcgactccatgaagtcggaatcgctagtaatcgtggatcagcatgccacggtgaatacgttcccgggccttgtacacaccgcccgtcacaccacgggagtcggttgtaccagaagcagttgacctaaccttcgggaaggaggctgccaaggtatggctgg

SEQ ID NO: 3174 - DNA, 1558 bp, Desulfobulbus oralis
  ref <308>: DATABASE ACCESSION NUMBER: NCBI ACCESSION: NZ_CP021255.1
  ref <309>: DATABASE ENTRY DATE: 2019-04-01
  ref <313>: RELEVANT RESIDUES IN SEQ ID NO: (1)..(1558)
gaactggagagtttgatcctggctcagaacgaacgctggcggcgtgcttaacacatgcaagtcgaacgcgaacgggacttcggttcctagtagagtggcgcacgggtgagtaacgcgtagataacctgtcttcatatccggaataacacgccgaaaggggtactaataccggatattcttgcatttcacaggtaaggcaaggaaaggtggcctctgattcaagctactgtatgaagaggggtctgcgtaccattagctagtaggtggggtaatggcctacctaggcgacgatggttagcgggtctgagaggatgatccgccacactggcactggaatacgggccagactcctacgggaggcagcagtgaggaatattgcgcaatgggggcaaccctgacgcagcgacgccgcgtgagtgaggaaggtcttcggatcgtaaagctctgtcaagagggaagaagtgcaaggcagcgaataactgttttgtttgacggtacctctaaaggaagcaccggctaactccgtgccagcagccgcggtaatacggagggtgcgagcgttgttcggaatcactgggcgtaaagggcgcgcaggcgggctgtcaagtcagatgtgaaatcccacggcttaactgtggacgtgcatttgaaactggcagtcttgagtaccagaggggaatgtggaattcccggtgtagaggtgaaattcgtagatatcgggaggaataccggtggcgaaggcgacattctggctggatactgacgctgaggcgcgaaagcgtggggagcaaacaggattagataccctggtagtccacgccgtaaacgatgtgaactagatgcagggggtgttgatcccctctgtgtcgcagctaacgcattaagttcaccgcctggggagtacggtcgcaagattaaaactcaaaggaattgacgggggcccgcacaagcggtggagtatgtggtttaattcgatgcaacgcgaagaaccttacctggtcttgacatcccggagacgcccatgaaagtgggtggtgccttctttgaaggaatccggagacaggtgctgcatggctgtcgtcagctcgtgtcgtgagatgttgggttaagtcccgcaacgagcgcaacccttgccttcagttgccagcggttcggccgggcactctgaagggactgccggtgtcaaaccggaggaaggcggggatgacgtcaagtcctcatggcccttatgaccagggctacacacgtactacaatggccggtacaaaggggagcgacattgcgaaatggagccaatcccggaaagccggtctcagtccggattggagtctgcaactcgactccatgaagttggaatcgctagtaatcgtggatcagcatgccacggtgaatacgttcccgggccttgtacacaccgcccgtcacaccacgggagtcggttgtaccagaagcagttgagctaaccgcaagggggcaggctgccaaggtacggctggtaactggggtgaagtcgtaacaaggtagccctaggggaacctggggctggatcacctccttt

SEQ ID NO: 3175 - DNA, 1562 bp, Desulfocapsa sulfexigens
  ref <308>: DATABASE ACCESSION NUMBER: NCBI ACCESSION: NC_020304.1
  ref <309>: DATABASE ENTRY DATE: 2019-04-01
  ref <313>: RELEVANT RESIDUES IN SEQ ID NO: (1)..(1562)
aaactggagagtttgatcctggctcagaacgaacgttggcggcgtgcttaacacatgcaagtcgaacgcgaacggtttcttcggagacctagtagagtggcgcacgggtgagtaacgcgtaagtaatctaccctcgcatcagggataactacgggaagctgtagctaataccggatacgttctcctatttacggactggagaagaaagatggcctcttcatgaaagctatcgtgcggggaggagcttgcgtaccattagctagttggtagggtaatggcctaccaaggcgacgatggttagcgggtctgagaggatgatccgccacactggaactgaaacacggaccagactcctacgggaggcagcagtgaggaatattgcgcaatgggggaaaccctgacgcagcgacgccgcgtggatgatgaaggccttagggtcgtaaaatcctgtcaggtgggaagaagtggttatagactaatactctatttctttgacggtaccaccaaaggaagcaccggctaactccgtgccagcagccgcggtaatacggagggtgcaaacgttgttcggaattactgggcgtaaagcgcgcgtaggcggtttgttaagtcagatgtgaaagcccatggctcaaccatggacgtgcatttgaaactggcagacttgagtactggagggggtgatggaattcccggtgtagaggtgaaattcgtagatatcgggaggaataccggtggcgaaggcgatcacctggccagatactgacgctgaggtgcgaaagcgtggggagcaaacaggattagataccctggtagtccacgccgtaaacgatgtcaactaggtgttggggcggttaatcgtctcattgccgaagctaacgcattaagttgaccgcctggggagtacggtcgcaagattaaaactcaaaggaattgacgggggcccgcacaagcggtggagtatgtggtttaattcgacgcaacgcgcagaaccttacctggtcttgacatcccgggaatctcttagaaataagagagtgcctcattagaggagcctggtgacaggtgctgcatggctgtcgtcagctcgtgtcgtgagatgttgggttaagtcccgcaacgagcgcaacccttgcctttagttgccatcattaagttgggcactctagagggactgccggtgtcaaaccggaggaaggtggggatgacgtcaagtcctcatggcctttatgaccagggctacacacgtactacaatggcatgtacaaaaggcagccacttcgcgagaaggagcgaatccttaaaacatgtctcagtccggattggagtctgcaactcgactccatgaagttggaatcgctagtaatcgtagatcagcatgctacggtgaatacgttcccgggccttgtacacaccgcccgtcacaccacgggagttggttgtaccagaagtagttgagcgaacttttcggagacgcaggctaccaaggtatgatcggtaactggggtgaagtcgtaacaaggtagccctaggggaacctggggctggatcacctcctttta

SEQ ID NO: 3176 - DNA, 1565 bp, Desulfocarbo indianensis
  ref <308>: DATABASE ACCESSION NUMBER: NCBI ACCESSION: NZ_LBMP01000001.1
  ref <309>: DATABASE ENTRY DATE: 2019-04-01
  ref <313>: RELEVANT RESIDUES IN SEQ ID NO: (1)..(1565)
taactggagagtttgatcctggctcagaacgaacgctggcggcaggcctaacacatgcaagtcgcacgagaacgtctcgcttcggtgaggctagtaaagtggcgcacgggtgagtatcgcgtgggtaatctacctttgggcacgggataacgtctcgaaaggggcgctaataccgtataagaccacagtaaccccggttgctgcggtaaaagggggcctctacatgtaagctcccacctgatgatgagcccgcgtcccattagcttgttggtgaggtaacggctcaccaaggccgcgatgggtagctggtctgagaggatgatcagccacactgggactggaacacggcccagactcctacgggaggcagcagtgaggaatcttgcgcaatgggggaaaccctgacgcagccatgccgcgtgggtgaagaaggccttcgggtcgtaaagccctgtcaggagggaagaaccgtttgcagtccaataaactgcaagcctgacggtaccttcaaaggaagcaccggctaactccgtgccagcagccgcggtaatacggagggtgcaagcgttgttcggaattactgggcgtaaagggtgtgcaggcggctaggtaagtccgatgtgaaatccctcggctcaactgaggatgtgcatcggatactgcttggcttgagtctcggagaggggggtggaattcccggtgtagaggtgaaattcgtagatatcgggaggaacaccagtggcgaaggcgaccccctggacgatgactgacgctgatacacgaaagcgtgggtagcaaacaggattagataccctggtagtccacgccgtaaacggtgtccactaggtgtcgtgggtattgacccccgcggtgccgcagctaacgcattaagtggaccgcctggggagtacggccgcaaggttaaaactcaaaggaattgacgggggcccgcacaagcggtggagtatgtggtttaattcgacgcaacgcgcagaaccttacctgggtttgacatccccggacagcctatgaaagtaggtttccacttcggtggccgggtgacaggtgctgcatggctgtcgtcagctcgtgtcgtgagatgttgggttaagtcccgcaacgagcgcaacccctgtctctagttgccagtatttagttaggcactctagggagaccgccccggttaacggggaggaaggtggggatgacgtcaagtcctcatggcccttatgcccagggctacacacgtactacaatggccggtacaaagggccgcaatactgcgaagtggagctaatcccaaaaaaccggtctcagttcggattggagtctgcaactcgactccatgaaggtggaatcgctagtaatcccggatcagcatgccggggtgaatacgttcccgggccttgtacacaccgcccgtcacaccacgaaagcctgttgtaccagaagtggccgagccaacccgtaaggggggcaggtccccaaggtatggccggtaattggggtgaagtcgtaacaaggtagccgtaggggaacctgcggctggatcacctcctttctaa

SEQ ID NO: 3177 - DNA, 1572 bp, Desulfococcus multivorans
  ref <308>: DATABASE ACCESSION NUMBER: NCBI ACCESSION: NZ_FUWN01000006.1
  ref <309>: DATABASE ENTRY DATE: 2019-04-01
  ref <313>: RELEVANT RESIDUES IN SEQ ID NO: (1)..(1572)
tttaattggcgagtttgatcctggctcagaatgaacgctggcggcgtgcttaacacatgcaagtcgcacgagaacgcttctgcttgcaggggctagtaaagtggcgcacgggtgagtaacgcgtgggtaatctacccttggattcgggataacccttcgaaaggagtgctaataccggatgaagtcatttaggctgtggtttagatgatgaaaggtggcctctccgaggaagctaccgtttggggatgagcccgcgtaccattagcttgttggtggggtaacggcctaccaaggcgacgatggttagctggtctgagaggatgatcagccacactggaactgacacacggtccagactcctacgggaggcagcagtgaggaattttgcgcaatggggggaaccctgacgcagcaacgccgcgtgagtgaagaaggccttcgggtcgtaaagctctgtcgagtgggaagaaccttcgtatgttgaatatgcatacggactgacggtaccacagaaggaagcaccggctaactccgtgccagcagccgcggtaatacggagggtgcaagcgttattcggaattattgggcgtaaagagcgcgtaggcggctttgcaagtcaggtgtgaaatcccggggctcaaccccggaagagcatttgatactgtggagcttgagtatgggagagggaagtggaattcctggtgtagcggtgaaatgcgtagatatcaggaggaacaccggtggcgaaggcggcttcctggaccaatactgacgctgaggcgcgaaggcgtggggagcaaacaggattagataccctggtagtccacgcagtaaacgttgatcactaggtgtagcgggtattgacccctgctgtgccggagttaacgcattaagtgatccgcctggggagtacgatcgcaagattaaaactcaaaggaattgacgggggcccgcacaagcggtggagcatgtggtttaattcgacgcaacgcgaagaaccttacctggatttgacatccgcgggattcttatgaaaatagggagtgcccttcggggagccgcgagacaggtgctgcatggctgtcgtcagctcgtgtcgtgagatgttgggttaagtcccgcaacgagcgcaacccctgtcttcagttaccatcattaagttggggactctgaagatactgccccggttaacggggaggaaggtggggatgacgtcaagtcctcatggcctttatgtccagggctacacacgtgctacaatgggctgtacagagggtagcgatctcgcgagagcaagccaatcccaaaaagcagtccttagttcggattggagtctgcaactcgactccatgaagctggaatcgctagtaatcgcggatcagcatgccgcggtgaatacgttcccgggccttgtacacaccgcccgtcacaccatgagagttggttgtaccagaagttgttgggctaacccgcaagggaggcaggcacctaaggtatggctgatgattggggtgaagtcgtaacaaggtagccgttggggaaccagcggctggatcacctcctttctaagga

SEQ ID NO: 3178 - DNA, 1572 bp, Desulfococcus oleovorans
  ref <308>: DATABASE ACCESSION NUMBER: NCBI ACCESSION: NC_009943.1
  ref <309>: DATABASE ENTRY DATE: 2019-04-01
  ref <313>: RELEVANT RESIDUES IN SEQ ID NO: (1)..(1572)
tttaattggagagtttgatcctggctcagattgaacgctggcggcgtgcttaacacatgcaagtcgtacgagaaagtttcagcttgctgaaacaagtaaagtggcgcacgggtgagtaacgcgtgggtaatctgcccctgggttcgggataacccgccgaaaggcgagctaataccggataacatctttgacacctcggtgttaaagatcaaaggtagcctctacatgtaagcttctgccgagggatgagcccgcgtaccattagtttgttggtggggtaacggctcaccaagacgttgatggttagctggtctgagaggatgatcagccacactggaactgagacacggtccagactcctacgggaggcagcagtgaggaattttgcgcaatgggggaaaccctgacgcagcaacgccgcgtgagtgatgaaggctcttgggtcgtaaagctctgtcaagtggaaagaaaatatgcattataaatagtagtgcgtattgacggtaccgctaaaggaagcaccggctaactccgtgccagcagccgcggtaatacggggggtgcaagcgttaatcggatttattgggcgtaaagggcgcgcaggcggcctggtaagtcagatgtgaaagcccggggctcaaccccggaagtacatttgaaactatcaggcttgagtatgggagagggaagtggaattcctggtgtagcggtgaaatgcgtagatatcaggaggaacaccggtggcgaaggcgacttcctggaccaatactgacgctgaggcgcgaaggcgtgggtagcaaacaggattagataccctggtagtccacgcagtaaacgttgatcactaggtgtagcgggtctttacccctgctgtgccgaagctaacgcattaagtgatccgcctggggagtacgatcgcaaggttaaaactcaaaggaattgacgggggcccgcacaagcggtggagcatgtggtttaattcgacgcaacgcgaagaaccttacctggatttgacatcccgggaatttctatgaaagtagaaagtgcccttcggggaacccggtgacaggtgctgcatggctgtcgtcagctcgtgtcgtgagatgttgggttaagtcccgcaacgagcgcaacccctgtctttagttgccatcattcagttgggcactctaaagatactgccccggttaacggggaggaaggtggggatgacgtcaagtcctcatggcccttatgtccagggctacacacgtgctacaatgggctgtacaaagggttgcaaactcgcgagagtgagccaatcccaaaaagcagttctcagttcagattggagtctgcaactcgactccatgaagttggaatcgctagtaatcgtggatcagcatgccacggtgaatacgttcccgggccttgtacacaccgcccgtcacaccatgagagttggttgtacccgaagttgctgggccaacccattcgggaggcaggtacctaaggtatggctgatgattggggtgaagtcgtaacaaggtagccgtaggggaacctgcggctggatcacctcctttctaagga

SEQ ID NO: 3179 - DNA, 1013 bp, Desulfocurvus vexinensis
  ref <308>: DATABASE ACCESSION NUMBER: NCBI ACCESSION: NZ_JAEX01000058.1
  ref <309>: DATABASE ENTRY DATE: 2019-04-01
  ref <313>: RELEVANT RESIDUES IN SEQ ID NO: (1)..(1013)
caactggagagtttgatcctggctcagattgaacgctggcggcgtgcctaacacatgcaagtcgagcgagaaagtccccttcgggggatgagtagagcggcgcacgggtgagtaacgcgtggataatctgcctcaagggtcgggataacagctggaaacggctgctaataccggatacgctgcattttaatcgatgtaggaaagatggcctctgcatgcaagctatcgccttgagatgagtccgcgtcccattagctagttggcggggtaatggcccaccaaggcgacgatgggtagctggtctgagaggatgatcagccacactgggactggaacacggcccagactcctacgggaggcagcagtggggaatattgcgcaatggacgaaagtctgacgcagcgacgccgcgtgcgggacgaaggccttcgggtcgtaaaccgctgtcaggagggaagaaccctggtagttcgaatagggctgccagctgacggtacctccagaggaagcaccggctaactccgtgccagcagccgcggtaatacggagggtgcaagcgttaatcggaatcactgggcgtaaagcgtgcgtaggcggcctgtcaagtcaggtgtgaaagccctcggcttaaccgaggaattgcacttgaaactgatgggctggagttctggagagggtggcggaattcccggtgtaggagtgaaatccgtagatatcgggaggaacaccagtggcgaaggcggccacctggacagtaactgacgctgaggtacgaaagcgtggggagcaaacaggattagataccctggtagtccacgctgtaaacgatggatgctaggtgtcgggcagcaatgttcggtgccgtagttaacgcgttaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatc

SEQ ID NO: 3180 - DNA, 1282 bp, Desulfofaba hansenii
  ref <308>: DATABASE ACCESSION NUMBER: NCBI ACCESSION: NZ_PESK01000201.1
  ref <309>: DATABASE ENTRY DATE: 2019-04-01
  ref <313>: RELEVANT RESIDUES IN SEQ ID NO: (1)..(1282)
gcccaccaaggccgcgatggttagctggtctgagaggatgatcagccacactgggactgacacacggcccagactcctacgggaggcagcagtgaggaattttgcgcaatgggggaaaccctgacgcagcaatgccgcgtgagtgatgaaggcccttgggtcgtaaaactctgtcaagcgggaagaacggatcgaaggttaataccctttgattttgacggtaccgctgaaggaagcaccggctaactccgtgccagcagccgcggtaatacggggggtgcaagcgttattcggaattattgggcgtaaagcgcgcgtaggcggcttcgtaggtcagatgtgaaatcccggggctcaaccccggcagtgcatttgaaaccccgaagcttgagtatgggagagggaagtggaattccaggtgtagaggtgaaattcgtagatatctggaggaacaccggtggcgaaggcgacttcctggaccaatactgacgctgaggtgcgaaggcgtggggagcaaacaggattagataccctggtagtccacgcagtaaacgatgatcactaggtgttgagggtattgactccttcagtgccgcagctaacgcattaagtgatccgcctggggagtacgatcgcaagattaaaactcaaagaaattgacgggggcccgcacaagcggtggagcatgtggtttaattcgacgcaacgcgcagaaccttacctggatttgacatcctgggaatcatttggaaacttttgagtgcccttcggggagcccagtgacaggtgctgcatggctgtcgtcagctcgtgtcgtgagatgtttggttaagtccagcaacgagcgcaacccctatcttcagttaccatcatttggttggggactctggagatactgccccggttaacggggaggaaggtggggatgacgtcaagtcctcatggcccttatatccagggctacacacgtgctacaatggcgtgtacaaagggtagcaagccggtgacggtaagccaatcccataaagcacgcctcagttcggattggagtctgcaactcgactccatgaagttggaatcgctagtaatcgcggatcagcatgccgcggtgaatacgttcccgggccttgtacacaccgcccgtcacaccatgagagttgattgtaccagaagtcgcccagctaaccttcggggggcaggcgcctaaggtatggttgataattagggtgaagtcgtaacaaggtagccgttggggaaccagcggctggatcacctcctttct

SEQ ID NO: 3181 - DNA, 1446 bp, Desulfofundulus salinum
  ref <308>: DATABASE ACCESSION NUMBER: NCBI ACCESSION: NZ_RBWE01000001.1
  ref <309>: DATABASE ENTRY DATE: 2019-04-01
  ref <313>: RELEVANT RESIDUES IN SEQ ID NO: (1)..(1446)
tagcggcggacgggtgagtaacgcgtggataacctgcccattagaccgggataacgccgggaaactggcgctaataccggatacgctccttgggccgcatggcatgaggaggaaagggggaacccgctaatggatgggtccgcgtcccattagctagatggtggggtaacggcctaccatggcgacgatgggtagccggcctgagagggtgaccggccacactgggactgagacacggcccagactcctacgggaggcagcagtggggaatcttccgcaatgggcgaaagcctgacggagcgacgccgcgtgagcgaggaaggccttcgggtcgtaaagctctgttctgggggaagaagtgcgtgacggtaccccaggaggaagccccggctaactacgtgccagcagccgcggtaagacgtagggggcgagcgttgtccggaattactgggcgtaaagggcgcgtaggcggcccaagaagtcaggggtgaaataccgcagctcaactgcgggggtgcctttgaaaccattgggcttgagggcaggagaggggagtggaattcccggtgtagcggtgaaatgcgtagatatcgggaggaacaccagtggcgaaggcggctctctggcctggccctgacgctgaggcgcgaaagcgtggggagcaaacaggattagataccctggtagtccacgctgtaaacgatgggtgctaggtgttggggggttaggacccttcagtgccgtagcaaacgcaataagcaccccgcctggggagtacggccgcaaggctgaaactcaaaggaattgacgggggcccgcacaagcggtggagcatgtggtttaattcgacgcaacgcgaagaaccttaccagggcttgacatcccctgacggccgtggaaacacggaattcacgggagaaatcctgtgacagggagacaggtggtgcatggttgtcgtcagctcgtgtcgtgagatgttgggttaagtcccgcaacgagcgcaacccctacggttagttgctaacgggtaaagccgagcactctagccgaactgccgttgacaaaacggaggaaggtggggatgacgtcaaatcatcatgccccttatgtcctgggctacacacgtgctacaatggccggtacaaagggcagcgaacccgcgagggggagcgaatcccaaaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagccgacaacacccgaagccggtgagctaacccgaaagggaggtagccgtcgaaggtggggttggtgattggggtgaagtcgtaacaaggtagccgtatcggaaggtgcggctggatcacctcctttctaaggag

SEQ ID NO: 3182 - DNA, 1560 bp, Desulfofustis glycolicus
  ref <308>: DATABASE ACCESSION NUMBER: NCBI ACCESSION: NZ_FQXS01000088.1
  ref <309>: DATABASE ENTRY DATE: 2019-04-01
  ref <313>: RELEVANT RESIDUES IN SEQ ID NO: (1)..(1560)
aaactggagagtttgatcctggctcagaacgaacgctggcggcgtgcttaacacatgcaagtcgaacgcgaacggttccttcggggaccaagtagagtggcgcacgggtgagtaacgcgtaagtaatctccccttgcattcggaataactcaccgaaaggtgtgctaataccggatacgtctggaataatgactttttttcagagaaaggcagcctctatttataagctgtcgtgcaaggatgagcttgcgtaccattagctagttggtagggtaagggcctaccaaggcgacgatggttagcgggtctgagaggatgatccgccacactggaactggaacacggaccagactcctacgggaggcagcagtgaggaatattgcgcaatgggggcaaccctgacgcagcgacgccgcgtggatgatgaaggccttcgggttgtaaaatcctgtcagatgggaagaaatgtatgggtattaatagtgcccgtatttgacggtaccatcaaaggaagcaccggctaactccgtgccagcagccgcggtaatacggagggtgcgagcgttgttcggaattactgggcgtaaagcgcgcgtaggcggcactttaagtcatttgtgaaagtccacggctcaaccgtggaagtgcatgtgaaactggagtgcttgagtactggagggggtggtggaattcccggtgtagaggtgaaattcgtagatatcgggaggaataccggtggcgaaggcgaccacctggccagatactgacgctgaggtgcgaaagcgtggggagcaaacaggattagataccctggtagtccacgccgtaaacgatgtcaactaggtgttgggatggttaatcgtctcattgccggagcaaacgcattaagttgaccgcctggggagtacggtcgcaagattaaaactcaaaggaattgacgggggcccgcacaagcggtggagtatgtggtttaattcgacgcaacgcgcagaaccttacctggtcttgacatcccgggaatcctgtggaaacacgggagtgcctttcgaggaacccggagacaggtgctgcatggctgtcgtcagctcgtgtcgtgagatgttgggttaagtcccgcaacgagcgcaacccttgtctttagttgccagcattaagttgggcactctaaagagactgccggtgtcaaaccggaggaaggtggggatgacgtcaagtcctcatggcctttatgatcagggctacacacgtactacaatggccggtacaacgggcagcaacacagcgatgtgaagcgaatctcgcaaagccggtctcagtccggattggagtctgcaactcgactccatgaagttggaatcgctagtaatcgcggatcagcatgccgcggtgaatacgttcccgggccttgtacacaccgcccgtcacaccacgggagttggttgtaccagaagcagttgagctaactattcgtagaggcaggctgccaaggtatgatcggtaactggggtgaagtcgtaacaaggtagccctaggggaacctggggctggatcacctccttt

SEQ ID NO: 3183 - DNA, 1558 bp, Desulfohalobium retbaense
  ref <308>: DATABASE ACCESSION NUMBER: NCBI ACCESSION: NC_013223.1
  ref <309>: DATABASE ENTRY DATE: 2019-04-01
  ref <313>: RELEVANT RESIDUES IN SEQ ID NO: (1)..(1558)
aaactggagagtttgattctggctcagaatgaacgctggcggcgtgcctaacacatgcaagtcgagcgagaaagtttccttcgggagacgagtacagcggcgcacgggtgagtaacgcgtggataatctacctcgaggtatgggataactctgcgaaagcggggctaataccgtatagtctgcacacatatcgtgtgtggtaaagatggcctctgatataagctatcgccttgggatgagtccgcgtctcattagcttgttggtggggtaaaagcttaccaaggcaacgatgggtagctggtctgagaggatgatcagccacactgggactggaacacggcccagactcctacgggaggcagcagtggggaatattgggcaatgggcgcaagcctgacccagcaacgccgcgtgtgggatgaaggctttcgggtcgtaaaccactgtcaggagggaagaaatgggtgattcccaatacgggtcacccttgacggtacctccagaggaagcaccggctaactccgtgccagcagccgcggtaatacggagggtgcaagcgttattcggaatcactgggcgtaaagcgcgcgtaggcggcagggcaagtcaggtgtgaaagcccacggctcaaccgtggaactgcacttgaaactgtcttgctagagtatgggagagggtggcagaattcccggtgtaggagtgaaatccgtagatatcgggaggaataccagtggcgaaggcggccacctggaccataactgacgctgaggtgcgaaagcgtggggagcaaacaggattagataccctggtagtccacgccgtaaacgatggatgctaggtgttggggtcgtaggacttcagtgccgtagttaacgcgttaagcatcccgcctggggagtacggtcgcaaggctgaaactcaaagaaattgacgggggcccgcacaagcggtggagtatgtggtttaattcgatgcaacgcgaagaaccttacccaggcttgacatcccgggagcctccatgaaattggagggtgcccttcggggaacccggtgacaggtgctgcatggctgtcgtcagctcgtgccgtgaggtgttgggttaagtcccgcaacgagcgcaacccctatccttagttgccagcaagtgatgttgggcactctaaggagactgccgaggtgaactcggaggaaggtggggacgacgtcaagtcatcatggcccttacgcctggggctacacacgtactacaatggtgggcacagagggtagcaacatcgcgaggtagagctaatctcaaaaagcccatctcagttcggatcgcagtctgcaactcgactgcgtgaagtcggaatcgctagtaatcgcggatcagcatgccgcggtgaatacgttcccgggccttgtacacaccgcccgtcacaccacgaaagctggctctacccgaagtcagtgagctaacccgtatgggaagcagctgccgacggtagggctggtaattggggtgaagtcgtaacaaggtagccgtaggggaacctgcggctggatcacctcctttaaa

SEQ ID NO: 3184 - DNA, 1550 bp, Desulfomicrobium baculatum
  ref <308>: DATABASE ACCESSION NUMBER: NCBI ACCESSION: NC_013173.1
  ref <309>: DATABASE ENTRY DATE: 2019-04-01
  ref <313>: RELEVANT RESIDUES IN SEQ ID NO: (1)..(1550)
taactggagagtttgattctggctcagaatgaacgctggcggcgtgcctaacacatgcaagtcgtacgagaaaggggcttcggccctgagtagagtggcgcacgggtgagtaacgcgtgggtaatctacccttggatttgggataactctgcgaaagtggagctaataccggatagtctggctttaaataagaagtcggtaaaggatgcctctgcatatgcattcgtccgaggatgagcccgcgtctcattagctagttggtagggtaatggcctaccaaggcaacgatgagtagctggtctgagaggatgatcagccacactggaactgaaacacggtccagactcctacgggaggcagcagtggggaatattgcgcaatgggcgaaagcctgacgcagcaacgccgtgtgagggatgaaggctttcgggtcgtaaacctctgtcggaagggaagaacgggcattggtctaataggcctttgttttgacggtacctttagaggaagcaccggctaactccgtgccagcagccgcggtaatacggagggtgcaagcgttattcggaattactgggcgtaaagcgcacgtaggcggccttgtaagtcaggggtgaaatcccacggctcaaccgtggaactgcctttgaaactgcagggcttgaatcctggagagggtggcggaattcctggtgtaggagtgaaatccgtagatatcaggaggaacaccggtggcgaaggcggccacctggacaggtattgacgctgaggtgcgaaagtgtggggagcaaacaggattagataccctggtagtccacaccgtaaacgatggatactaggtgtcggggacttgatcttcggtgccgtagctaacgcgttaagtatcccgcctggggagtacggtcgcaaggctgaaactcaaagaaattgacgggggcccgcacaagcggtggagtatgtggtttaattcgatgcaacgcgaagaaccttacctaggcttgacatcctgggaatcctgcagagatgcgggagtgcccttcggggaatccagagacaggtgctgcatggctgtcgtcagctcgtgccgtgaggtgttgggttaagtcccgcaacgagcgcaacccctattctcagttgccatcacgtaatggtgggcactctgtggagactgcccgggttaaccgggaggaaggtggggatgacgtcaagtcatcatggcccttacgcctagggctacacacgtactacaatggtgggtacaaagggcagcgaaaccgcgaggtcgagcgaatctcaaaaaacccatcatagtccggattgcagtctgcaactcgactgcatgaagttggaatcgctagtaatcccggatcagcatgccggggtgaatacgttcccgggccttgtacacaccgcccgtcacaccacgaaagtcggttctacccgaagtcgccggactaacccttgggaggtaggcgcctacggtagggctggtaattggggtgaagtcgtaacaaggtagccgtaggggaacctgcggctggatcacctcctta

SEQ ID NO: 3185 - DNA, 1556 bp, Desulfomicrobium orale
  ref <308>: DATABASE ACCESSION NUMBER: NCBI ACCESSION: NZ_CP014230.1
  ref <309>: DATABASE ENTRY DATE: 2019-04-01
  ref <313>: RELEVANT RESIDUES IN SEQ ID NO: (1)..(1556)
tttgtaactggagagtttgattctggctcagaatgaacgctggcggcgtgcctaacacatgcaagtcgaacgagaaagttccttcgggaatgagtagagtggcgcacgggtgagtaacgcgtgggtaatctgcccttggatttgggataacttcgcgaaagtggagctaataccggatagtctggctttgtaaaaggagtcggtaaaggatgcctctgcatatgcattcgtccgaggatgagcccgcgtctcattagctagttggtagggtaacggcctaccaaggcgacgatgagtagctggtctgagaggatgatcagccacactgggactgaaacacggcccagactcctgcgggaggcagcagtggggaatattgcgcaatgggcgaaagcctgacgcagcaacgccgtgtgagggatgaaggttttcggatcgtaaacctctgtcagaagggaagaagtggtgcgggtccaacaggcccgtatcttgacggtaccttcaaaggaagcaccggctaactccgtgccagcagccgcggtaatacggagggtgcaagcgttattcggaattactgggcgtaaagcgcacgtaggcggccttgtaagtcaggtgtgaaatcccacggctcaaccgtggaactgcacttgaaactgcggggctcgaatcctggagagggcggcggaattcctggtgtaggagtgaaatccgtagatatcaggaggaacaccggtggcgaaggcggccgcctggacaggtattgacgctgaggtgcgaaagtgtggggagcaaacaggattagataccctggtagtccacaccgtaaacgatggatactaggtgtcggggacttgatcctcggtgccgcagttaacgcgttaagtatcccgcctggggagtacggtcgcaaggctgaaactcaaagaaattgacgggggcccgcacaagcggtggagtatgtggtttaattcgatgcaacgcgaagaaccttacctgggcttgacatcctgggaattccgcagagatgcggaagtgcccttcggggaatccagagacaggtgctgcatggctgtcgtcagctcgtgccgtgaggtgttgggttaagtcccgcaacgagcgcaacccctatcctcagttgccagcaggtaaagctgggcactctgtggagactgcccgggttaaccgggaggaaggtggggacgacgtcaagtcatcatggcccttacgcccagggctacacacgtactacaatggtgggcacaaagggcagcgaaaccgcgaggtccagccaatcccaaaaaaaccatcatagtccggattgcagtctgcaactcgactgcatgaagttggaatcgctagtaatcccggatcagcatgccggggtgaatacgttcccgggccttgtacacaccgcccgtcacaccacgaaagtcggttctacccgaagccgccaggctaacccgcaagggatgcaggcgtctacggtagggctggtaattggggtgaagtcgtaacaaggtagccgtaggggaacctgcggctggatcacctcctta

SEQ ID NO: 3186 - DNA, 1563 bp, Desulfomonile tiedjei
  ref <308>: DATABASE ACCESSION NUMBER: NCBI ACCESSION: NC_018025.1
  ref <309>: DATABASE ENTRY DATE: 2019-04-01
  ref <313>: RELEVANT RESIDUES IN SEQ ID NO: (1)..(1563)
ttaaactggagagtttgatcctggctcagaacgaacgctggcggcgtgcctaacacatgcaagtcgtacgagaaacatatccttcggggtatggagtaaagtggcgcacgggtgagtaacacgtgggtaacctgccctatggttcgggataactggccgaaaggcccgctaataccggatgagaccacatgagctccggctcaaggggtcaaagtcggcctctcgacgaagccgatgccaaaggatgggctcgcggaccattagcttgttggtgaggtaacggctcaccaaggccgagatggttagctggtctgagaggatgatcagccacactggaactgagacacggtccagactcctacgggaggcagcagtgaggaatattgcgcaatggaggaaactctgacgcagcaacgccgcgtgggtgaagaaggctttcgggttgtaaagccctgtcaggcgggaagaaacctttgcggacgaatagtccgtgaaactgacggtaccgccaaaggaagcaccggctaactccgtgccagcagccgcggtaagacggagggtgcaagcgttgttcggaatcactgggcgtaaagcgcgtgtaggcggttcgataagtcgaatgtgaaagcccgaggctcaacctcggaagtgcattcgaaactgtcgggcttgagtacgggagagggaagtggaattcctggtgtagaggtgaaattcgtagatatcaggaggaacaccggtggcgaaggcggcttcctggaccgatactgacgctgagacgcgaaagcgtggggagcaaacaggattagataccctggtagtccacgccgtaaacggtgagcactaggtgtagcgggtattgacccctgctgtgccgcagctaacgcattaagtgctccgcctggggagtacggtcgcaagattaaaactcaaaggaattgacgggggcccgcacaagcggtggagcatgtggtttaattcgatgcaacgcgaagaaccttacctgggcttgaaatcgcccggacagtcgtggaaacacgatctccttcgggccgggtgacaggtgctgcatggctgtcgtcagctcgtgtcgtgagatgttgggttaagtcccgcaacgagcgcaacccctgcctttagttgccatcattaagttgggaactctaaagggactgccggtgttaaaccggaggaaggtggggacgacgtcaagtcctcatggcccttatgtccagggctacacacgtgctacaatggaccgtacaaagggctgcaaacctgtgaaggggagcaaatcccaaaaaacggttctcagttcggattggagtctgcaactcgactccatgaagttggaatcgctagtaatcgcggatcagcatgccacggtgaatacgttcccgggccttgtacacaccgcccgtcacaccacgaaagttgactgcaccagaagtcgctgggctaacccgcaagggaggcaggcgcctaaggtgtggttgatgattggggtgaagtcgtaacaaggtagccgtaggggaacctgcggctggatcacctcctttctaa

SEQ ID NO: 3187 - DNA, 1648 bp, Desulfonatronospira thiodismutans
  ref <308>: DATABASE ACCESSION NUMBER: NCBI ACCESSION: NZ_ACJN02000001.1
  ref <309>: DATABASE ENTRY DATE: 2019-04-01
  ref <313>: RELEVANT RESIDUES IN SEQ ID NO: (1)..(1648)
ttcaactggagggtttgattctggctcagaatgaacgctggcggcgtgcctaacacatgcaagtcgagcgagaaagttccttcgggagcgagtaaagcggcgaacgggtgagtaacgcgtggataatctaccttcgggtccgggataactccgcgaaagcggggctaatactggatggtccccgcacttactttatttacggattctaaggctcatggctgatcaggaggttttattcctttataatcagccatgaggccaagaatccgttgataaagtaagtgcggggtaaagatggcctctgattcaagctatcgcctggagatgagtccgcgtcccattagcttgttggtggggtaaaggcctaccaaggcgacgatgggtagctggtctgagaggatgatcagccacactgggactggaacacggcccagactcctacgggaggcagcagtggggaatattgggcaatgggggcaaccctgacccagcaacgccgtgtgagggaagaaggttttcggatcgtaaacctctgtcaggagggaagaacgggctgaagtcgaacaggctttagttttgacggtacctccagaggaagcaccggctaactccgtgccagcagccgcggtaatacggagggtgcgagcgttattcggaattactgggcgtaaagcgcgcgtaggcggcacggcaagtcagatgtgaaagccctgggctcaacctgggaattgcatttgaaactgccgagctagagtaaggtagagggtggcggaattcccggtgtaggggtgaaatccgtagatatcgggaggaacaccagtggcgaaggcggccacctgggcctttactgacgctgaggtgcgaaagcgtgggtagcaaacaggattagataccctggtagtccacgccgtaaacgatggatactaggtgctgggttttaaattcggtgccgtagctaacgcgttaagtatcccgcctggggagtacgatcgcaaggttgaaactcaaagaaattgacgggggcccgcacaagcggtggagtatgtggtttaattcgatgcaacgcgaagaaccttacctgggcttgacatcccgcgaattccgtagagatacggaagtgcccttcggggagcgcggtgacaggtgctgcatggctgtcgtcagctcgtgccgtgaggtgttgggttaagtcccgcaacgagcgcaacccctgtccttagttgccatcgggtagagccgggcactctaaggagactgccgaggttaactcggaggaaggtggggatgacgtcaagtcatcatggcccttacgcccagggctacacacgtactacaatggtggggacaaagggtagcgagactgtgaggtggagcaaatctcaaaaaccccatcgtagttcggattgcagtctgcaactcgactgcatgaagttggaatcgctagtaatcgcggatcagcatgccgcggtgaatacgttcccgggccttgtacacaccgcccgtcacaccacgaaagtcggttctacccgaagccgctgagccaaccgtgtttcgacatgggggcaagcgtccacggtagggccggtaattggggtgaagtcgtaacaaggtagccgtaggggaacctgcggctggatcacctccttta

SEQ ID NO: 3188 - DNA, 1480 bp, Desulfonatronovibrio hydrogenovorans
  ref <308>: DATABASE ACCESSION NUMBER: NCBI ACCESSION: NZ_JMKT01000006.1
  ref <309>: DATABASE ENTRY DATE: 2019-04-01
  ref <313>: RELEVANT RESIDUES IN SEQ ID NO: (1)..(1480)
cttcggtccctgagtaaagcggcgcacgggtgagtaacgcgtggataatctaccgagaggaccgggacaactttgcgaaagcggagctaataccggatggtctgcatttgtttattgcatatgtagtaaaggatggcctctgatgtaagccattgccttttgatgagtccgcgtctcattagctagttggtggggtaaaggcctaccaaggcaacgatgagtagctggtctgagaggatgatcagccacactggaactggaacacggtccagactcctacgggaggcagcagtggggaatattgggcaatgggggcaaccctgacccagcaacgccgtgtgagggaagaaggttttcggatcgtaaacctctgtcaggagggaagaagtgcatggcaagtaatatgtgtcatgtttgacggtacctccaaaggaagcaccggctaactccgtgccagcagccgcggtaatacggagggtgcgagcgttattcggaattactgggcgtaaagcgcgcgtaggcggcgcggcaagtcagatgtgaaagccccgggctcaacctgggaattgcatttgaaactgccgtgcttgagtgaggtagagggtggcggaattcccggtgtaggagtgaaatccgtagatatcgggaggaacaccagtggcgaaggcggccacctgggcctttactgacgctgaggtgcgaaagcgtgggtagcaaacaggattagataccctggtagtccacgctgtaaacgatggatactaggtgctgggagagaatttcggtgccgtagctaacgcgttaagtatcccgcctggggagtacgatcgcaaggttgaaactcaaagaaattgacgggggcccgcacaagcggtggagtatgtggtttaattcgatgcaacgcgaagaaccttacctggacttgacatcctgcgaaccctgtagagatacgggggtgcccttcggggagcgcagagacaggtgctgcatggctgtcgtcagctcgtgccgtgaggtgttgggttaagtcccgcaacgagcgcaacccctattcttagttgccatcaggtaaagctgggcactctatggagactgccgaggttaactcgggggaaggtggggacgacgtcaagtcatcatggcccttacgtccagggctacacacgtactacaatggtggggacaacgggtcgcgaggccgcgaggtggagctaatcccaaaaaccccatcacagttcggattgcagtctgcaactcgactgcatgaagttggaatcgctagtaatcgcggatcagcatgccgcggtgaatacgttcccgggccttgtacacaccgcccgtcacaccacgaaagttggttttacccgaagccgccgggctaacccgcaagggaggcaggcgtccacggtagggctgataattggggtgaagtcgtaacaaggtagccgtaggggaacctgcggctggatcacctccttta

SEQ ID NO: 3189 - DNA, 1560 bp, Desulfonatronovibrio magnus
  ref <308>: DATABASE ACCESSION NUMBER: NCBI ACCESSION: NZ_JYNP01000024.1
  ref <309>: DATABASE ENTRY DATE: 2019-04-01
  ref <313>: RELEVANT RESIDUES IN SEQ ID NO: (1)..(1560)
tttaactggagggtttgattctggctcagaatgaacgctggcggcgtgcctaacacatgcaagtcgagcgagaaagagagcttcggctcttgagtaaagcggcgcacgggtgagtaacgcgtggataatctgccttaaggaccgggacaactttgcgaaagcggagctaataccggatggtctgcatttgtttattacatatgtagtaaaggatggcctctgatttaagccattgccttgagatgagtccgcgtctcattagctagttggtggggtaagagcctaccaaggcgacgatgagtagctggtctgagaggatgatcagccacactggaactggaacacggtccagactcctacgggaggcagcagtggggaatattgggcaatgggggcaaccctgacccagcaacgccgtgtgagggaagaaggttttcggatcgtaaacctctgtcagaagggaagaagtgcatgccaagtaatatgtggtatgtttgacggtaccttcagaggaagcaccggctaactccgtgccagcagccgcggtaatacggagggtgcgagcgttattcggaattactgggcgtaaagcgcgcgtaggctgcgcggcaagtcagatgtgaaatccccgggctcaacctgggaattgcatttgaaactgccgtgcttgagtgaggtagagggtggcggaattcccggtgtaggagtgaaatccgtagatatcgggaggaacaccagtggcgaaggcggccacctgggcctttactgacgctgaggtgcgaaagcgtgggtagcaaacaggattagataccctggtagtccacgctgtaaacgatggatactaggtgctgggatagaatttcggtgccgtagctaacgcgttaagtatcccgcctggggagtacgatcgcaaggttgaaactcaaagaaattgacgggggcccgcacaagcggtggagtatgtggtttaattcgatgcaacgcgaagaaccttacctggacttgacatcctgcgaattttgtagagatacgaaagtgcccttcggggagcgcagagacaggtgctgcatggctgtcgtcagctcgtgccgtgaggtgttgggttaagtcccgcaacgagcgcaacccctattcttagttgccatcaggtaaagctgggcactctatggagactgccgaggttaactcgggggaaggtggggacgacgtcaagtcatcatggcccttacgtccagggctacacacgtactacaatggtggggacagagggcagcgagactgcgaggtggagctaatcccaaaaaccccatcacagttcggattgcagtctgcaactcgactgcatgaagttggaatcgctagtaatcgcggatcagcatgccgcggtgaatacgttcccgggccttgtacacaccgcccgtcacaccacgaaagttggttctacccgaagccgccgggctaactcgcaagagaggcaggcgtccacggtagggctgataattggggtgaagtcgtaacaaggtagccgtaggggaacctgcggctggatcacctccttta

SEQ ID NO: 3190 - DNA, 1558 bp, Desulfonatronum lacustre
  ref <308>: DATABASE ACCESSION NUMBER: NCBI ACCESSION: NZ_KI912608.1
  ref <309>: DATABASE ENTRY DATE: 2019-04-01
  ref <313>: RELEVANT RESIDUES IN SEQ ID NO: (1)..(1558)
ttaagtggagagtttgatcctggctcagaatgaacgctggcggcgtgcctaacacatgcaagtcgagcgagaaagggtacttcggtacctgagtagagcggcgcacgggtgagtaacgcgtggataatctacccatggattcgggataacagtgggaaaccgctgctaataccggatgagctcatgcattttggagatgtgtgaggaaaggcggcctctgtttcaagctgccgtcgatggatgagtccgcgtcccattagcttgttggtggggtaaaggcctaccaaggcgacgatgggtagccggcctgagagggtggccggccacactgggactgaaacacggcccagactcctacgggaggcagcagtggggaatattgcgcaatgggcgaaagcctgacgcagcaacgccgcgtgagggaagaaggccttcgggtcgtaaacctctgtcaggagggaagaactgcatggattcgaatagggtctgtgtttgacggtacctccaaaggaagcaccggctaactccgtgccagcagccgcggtaatacggagggtgcaagcgttattcggaattactgggcgtaaagggcgtgtaggcggccttttaagtcaggtgtgaaatcccacggcttaaccgtggaactgcacttgaaactgggaggctggagtacgggagagggcggcggaattcccggtgtaggagtgaaatccgtagatatcgggaggaacaccagtggcgaaggcggccgcctggaccgtaactgacgctgagacgcgaaagcgtggggagcaaacaggattagataccctggtagtccacgctgtaaacgatggatgctaggtgtcggggagcaatcttcggtgccgtagttaacgcgttaagcatcccgcctggggagtacggtcgcaaggctgaaactcaaaggaattgacgggggcccgcacaagcggtggagtatgtggtttaattcgatgcaacgcgaagaaccttacctaggtttgacatcctttgaatccttcagagatgagggagtgcccttcggggagcaaagagacaggtgctgcatggctgtcgtcagctcgtgccgtgaggtgttgggttaagtcccgcaacgagcgcaacccttatctttagttgccatcaggtgaagctgggcactctagagagactgccccggttaacggggaggaaggtggggatgacgtcaagtcatcatggcccttacgcctagggctacacacgtactacaatggtgaatacaaagggcagcgagaccgcgaggtggagccaatcccaaaaagttcaccacagttcggattgcagtctgcaactcgactgcatgaagttggaatcgctagtaatcgcggatcagcatgccgcggtgaatacgttcccgggccttgtacacaccgcccgtcacaccacgaaagttggttctacccgaagccggcggactaacccgcaagggaggtagtcgtctacggtagggctgataattggggtgaagtcgtaacaaggtagccgtaggggaacctgcggctggatcacctccttt

SEQ ID NO: 3191 - DNA, 1556 bp, Desulfonatronum sp. SC1
  ref <308>: DATABASE ACCESSION NUMBER: NCBI ACCESSION: NZ_PZKN01000068.1
  ref <309>: DATABASE ENTRY DATE: 2019-04-01
  ref <313>: RELEVANT RESIDUES IN SEQ ID NO: (1)..(1556)
aagtggagagtttgatcctggctcagaatgaacgctggcggcgtgcctaacacatgcaagtcgagcgagaaagggtacttcggtacctgagtagagcggcgcacgggtgagtaacgcgtggataatctacccatggattcgggataacagtgggaaaccgctgctaataccggatgagctcatgcattttggagatgcgtgaggaaaggcggcctctgattcaagctgccgtcgatggatgagtccgcgtcccattagcttgttggtggggtaaaggcctaccaaggcgacgatgggtagccggcctgagagggtggccggccacactgggactgaaacacggcccagactcctacgggaggcagcagtggggaatattgcgcaatgggcgaaagcctgacgcagcaacgccgcgtgagggaagaaggccttcgggtcgtaaacctctgtcaggagggaagaagtgcatgaggtcgaacaggccttgtgtttgacggtacctccaaaggaagcaccggctaactccgtgccagcagccgcggtaatacggagggtgcaagcgttattcggaattactgggcgtaaagggcgtgtaggcggccttttaagtcaggtgtgaaatcccacggcttaaccgtggaactgcacttgaaactgggaggcttgagtacgggagagggcggcggaattcccggtgtaggagtgaaatccgtagatatcgggaggaacaccagtggcgaaggcggccgcctggaccgtaactgacgctgagacgcgaaagcgtggggagcaaacaggattagataccctggtagtccacgctgtaaacgatggatgctaggtgtcggggagcaatcttcggtgccgtagttaacgcgttaagcatcccgcctggggagtacggtcgcaaggctgaaactcaaaggaattgacgggggcccgcacaagcggtggagtatgtggtttaattcgatgcaacgcgaagaaccttacctaggtttgacatccttcgaatccctcagagatgagggagtgcccttcggggaacggagagacaggtgctgcatggctgtcgtcagctcgtgccgtgaggtgttgggttaagtcccgcaacgagcgcaacccttatctttagttgccatcaggtgaagctgggcactctagagagactgccccggttaacggggaggaaggtggggatgacgtcaagtcatcatggcccttacgcctagggctacacacgtactacaatggtgaatacaaagggcagcgagaccgcgaggtggagccaatcccagaaagttcaccacagttcggattgcagtctgcaactcgactgcatgaagttggaatcgctagtaatcgcggatcagcatgccgcggtgaatacgttcccgggccttgtacacaccgcccgtcacaccacgaaagttggttctacccgaagccggcggactaacccttcggggaggtagtcgtctacggtagggctgataattggggtgaagtcgtaacaaggtagccgtaggggaacctgcggctggatcacctccttt

SEQ ID NO: 3192 - DNA, 1109 bp, Desulfonatronum thioautotrophicum
  ref <308>: DATABASE ACCESSION NUMBER: NCBI ACCESSION: NZ_JYNO01000063.1
  ref <309>: DATABASE ENTRY DATE: 2019-04-01
  ref <313>: RELEVANT RESIDUES IN SEQ ID NO: (1)..(1109)
tttaagtggagagtttgatcctggctcagaatgaacgctggcggcgtgcctaacacatgcaagtcgagcgagaaaggggacttcggttcctgagtagagcggcgcacgggtgagtaacgcgtggataatctccccattgattcgggataacagtgggaaaccgctgctaataccgaataagctcatgcattttggagatgtgtggggaaaggcggcctctgattcaagctgccgtcgatggatgagtccgcgtcccattagcttgttggtggggtaaaggcctaccaaggcgacgatgggtagccggcctgagagggtggccggccacactgggactggaacacggcccagactcctacgggaggcagcagtggggaatattgcgcaatgggcgaaagcctgacgcagcaacgccgcgtgagggaagaaggccttcgggtcgtaaacctctgtcaggagggaagaatgtcatggattcgaacagggtccgtgtttgacggtacctccaaaggaagcaccggctaactccgtgccagcagccgcggtaatacggagggtgcaagcgttattcggaattactgggcgtaaagggcgtgtaggcggccttgtaagtcaggtgtgaaatcccacggcttaaccgtggaactgcacttgaaactgcttggctggagtacgggagagggcggcggaattcccggtgtaggagtgaaatccgtagatatcgggaggaacaccagtggcgaaggcggccgcctggaccgtaactgacgctgagacgcgaaagcgtggggagcaaacaggattagataccctggtagtccacgctgtaaacgatggatgctaggtgtcggcgagcaatcgtcggtgccgtagttaacgcgttaagcatcccgcctggggagtacggtcgcaaggctgaaactcaaaggaattgacgggggcccgcacaagcggtggagtatgtggtttaattcgatgcaacgcgaagaaccttacctaggtttgacatcctttgaatttctcagagatgaggaagtgcccttcggggagcaaagagacaggtgctgcatggctgtcgtcagctcgtgccgtgaggtgttgggttaagt

SEQ ID NO: 3193 - DNA, 1558 bp, Desulfonatronum thiodismutans
  ref <308>: DATABASE ACCESSION NUMBER: NCBI ACCESSION: NZ_JPIK01000029.1
  ref <309>: DATABASE ENTRY DATE: 2019-04-01
  ref <313>: RELEVANT RESIDUES IN SEQ ID NO: (1)..(1558)
ttaagtggagagtttgatcctggctcagaatgaacgctggcggcgtgcctaacacatgcaagtcgagcgagaaaggggacttcggttcctgagtagagcggcgcacgggtgagtaacgcgtggataatctacccatggattcgggataacagtgggaaaccgctgctaataccggatgagctcacgcattttggagatgcgtgaggaaaggcggcctctggaacaagctgccgtcgatggatgagtccgcgtcccattagcttgttggtggggtaaaggcctaccaaggcgacgatgggtagccggcctgagagggtggccggccacactgggactgaaacacggcccagactcctacgggaggcagcagtggggaatattgcgcaatgggcgaaagcctgacgcagcaacgccgcgtgagggaagaaggccttcgggtcgtaaacctctgtcaggagggaagaactgcatggattcgaacagggtccgtgtttgacggtacctccaaaggaagcaccggctaactccgtgccagcagccgcggtaatacggagggtgcaagcgttattcggaattactgggcgtaaagggcgtgtaggcggccttttaagtcaggtgtgaaagcccacggcttaaccgtggaactgcacttgaaactgggaggcttgagtacgggagagggcggcggaattcccggtgtaggagtgaaatccgtagatatcgggaggaacaccagtggcgaaggcggccgcctggaccgtaactgacgctgagacgcgaaagcgtggggagcaaacaggattagataccctggtagtccacgctgtaaacgatggatgctaggtgtcggggagcaatcttcggtgccgtagttaacgcgttaagcatcccgcctggggagtacggtcgcaaggctgaaactcaaaggaattgacgggggcccgcacaagcggtggagtatgtggtttaattcgatgcaacgcgaagaaccttacctaggtttgacatccttcgaatccctcagagatgagggagtgcccttcggggaacggagagacaggtgctgcatggctgtcgtcagctcgtgccgtgaggtgttgggttaagtcccgcaacgagcgcaacccttatctttagttgccatcaggtaaagctgggcactctagagagactgccccggttaacggggaggaaggtggggatgacgtcaagtcatcatggcccttacgcctagggctacacacgtactacaatggtgaatacaaagggctgcgagaccgcgaggtggagccaatcccaaaaagttcaccacagttcggattgcagtctgcaactcgactgcatgaagttggaatcgctagtaatcgcggatcagcatgccgcggtgaatacgttcccgggccttgtacacaccgcccgtcacaccacgaaagttggttctacccgaagccggcggactaacccgtaagggaggtagtcgtctacggtagggctgataattggggtgaagtcgtaacaaggtagccgtaggggaacctgcggctggatcacctccttt

SEQ ID NO: 3194 - DNA, 1560 bp, Desulfonatronum thiosulfatophilum
  ref <308>: DATABASE ACCESSION NUMBER: NCBI ACCESSION: NZ_FMXO01000030.1
  ref <309>: DATABASE ENTRY DATE: 2019-04-01
  ref <313>: RELEVANT RESIDUES IN SEQ ID NO: (1)..(1560)
tttaagtggagagtttgatcctggctcagaatgaacgctggcggcgtgcctaacacatgcaagtcgagcgagaaagggggcttcggtccctgagtagagcggcgcacgggtgagtaacgcgtggataatctacccatggattcgggataacagtgggaaaccgctgctaataccggataagcttacgcattttggagatgtgtgagaaaaggcggcctctgtttcaagctgccgtcaatggatgagtccgcgtcccattagcttgttggtggggtaaaggcctaccaaggcgacgatgggtagccggcctgagagggtggccggccacactggaactgaaacacggtccagactcctacgggaggcagcagtggggaatattgcgcaatgggcgaaagcctgacgcagcaacgccgcgtgagggaagaaggccttcgggtcgtaaacctctgtcaggagggaagaactgcatgaggtcgaacaggccttgtgtttgacggtacctccaaaggaagcaccggctaactccgtgccagcagccgcggtaatacggagggtgcaagcgttattcggaattactgggcgtaaagcgcgtgtaggcggccttgtaagtcaggtgtgaaatcccacggctcaaccgtggaactgcacttgaaactgcttggctcgagtacgggagagggtggcggaattcccggtgtaggagtgaaatccgtagatatcgggaggaacaccagtggcgaaggcggccacctggaccgtaactgacgctgagacgcgaaagcgtggggagcaaacaggattagataccctggtagtccacgctgtaaacgatggatgctaggtgtcggggagcaatcttcggtgccgtagttaacgcgttaagcatcccgcctggggagtacggtcgcaaggctgaaactcaaaggaattgacgggggcccgcacaagcggtggagtatgtggtttaattcgatgcaacgcgaagaaccttacctaggtttgacatccttcgaatccttcagagatgagggagtgcccttcggggagcggagagacaggtgctgcatggctgtcgtcagctcgtgccgtgaggtgttgggttaagtcccgcaacgagcgcaacccttatctttagttgccagcacatgatggtgggcactctagagagactgccccggttaacggggaggaaggtggggatgacgtcaagtcatcatggcccttacgcctagggctacacacgtactacaatggtgaatacaaagggcagcgagaccgcgaggtggagccaatcccaaaaagttcaccacagttcggattgcagtctgcaactcgactgcatgaagttggaatcgctagtaatcgcggatcagcatgccgcggtgaatacgttcccgggccttgtacacaccgcccgtcacaccacgaaagttggttctacccgaagccggcggactaaccctcacgggaggtagtcgtctacggtagggctgataattggggtgaagtcgtaacaaggtagccgtaggggaacctgcggctggatcacctccttta

SEQ ID NO: 3195 - DNA, 1566 bp, Desulfonema ishimotonii
  ref <308>: DATABASE ACCESSION NUMBER: NCBI ACCESSION: NZ_BEXT01000001.1
  ref <309>: DATABASE ENTRY DATE: 2019-04-01
  ref <313>: RELEVANT RESIDUES IN SEQ ID NO: (1)..(1566)
tttatcggagagtttgatcctggctcagaatgaacgctggcggcgtgcttaacacatgcaagtcgcacgagaacaccctgcctcggcggggtaagtaaagtggcgcacgggtgagtaacgcgtgggtaatctgtctccgggtccgggataacgttgcgaaagcgacgctaataccggataacattcccgtgaccccggtcacggggatcaaaggtggcctctgtatacaagctaccgcctgggggtgaacccgcgtcccattagcttgtcggtggggtaacggcctaccgaggcgacgatgggtagctggtctgagaggatgatcagccacaccggaactggaacacggtccggactcctacgggaggcagcagtgaggaattttgcgcaatgggggaaaccctgacgcagcaacgccgcgtgagtgatgaaggccctcgggtcgtaaagctctgtcatgtgggaagaacctggggacggccaatacccgttcccactgacggtaccacagaaggaagcaccggctaactccgtgccagcagccgcggtaatacggagggtgcaagcgttattcggaattattgggcgtaaagagcgcgtaggcggcctttcaagtcagatgtgaaatcccgtggcttaaccatggaagtgcatttgatactgggaggcttgagtatgggagagggaaacggaattcctggtgtagcggtgaaatgcgtagatatcaggaggaacaccggtggcgaaggcggtttcctggaccaatactgacgctgaggcgcgaaggcgtggggagcaaacaggattagataccctggtagtccacgcagtaaacggtgatcactaggtgtagcgggtattgacccctgctgtgccggagcaaacgcattaagtgatccgcctggggagtacggtcgcaagattaaaactcaaaggaattgacgggggcccgcacaagcggtggagcatgtggtttaattcgacgcaacgcgcagaaccttacctggatttgacatcccgggaattttccggagacggagaagtgcccttcggggagcccggagacaggtgctgcatggctgtcgtcagctcgtgtcgtgagatgttgggttaagtcccgcaacgagcgcaacccctgtcttcagttaccatcattaggttggggactctgaagatactgccccggttaacggggaggaaggtggggatgacgtcaagtcctcatggcctttatgtccagggctacacacgtgctacaatgggcggtacaaagggtagcgatctcgcgagagcaagccaatcccataaagccgtccccagttcggatcggagtctgcaacccgactccgtgaagccggaatcgctagtaatcgcggatcagcatgccgcggtgaatacgttcccgggccttgtacacaccgcccgtcacaccatgagagtcggttgtaccagaagtcgtcgggccaacccttcggggaggcaggcgcctaaggtatggttgataattagggtgaagtcgtaacaaggtagccgttggggaaccagcggctggatcacctcctttct

SEQ ID NO: 3196 - DNA, 1567 bp, Desulfonispora thiosulfatigenes
  ref <308>: DATABASE ACCESSION NUMBER: NCBI ACCESSION: NZ_FWWT01000029.1
  ref <309>: DATABASE ENTRY DATE: 2019-04-01
  ref <313>: RELEVANT RESIDUES IN SEQ ID NO: (1)..(1567)
ttaatggagagtttgatcctggctcaggacgaacgctggcggcatgcctaacacatgcaagtcgaacggacttttagtatttagtttactaaatactaaaagttagtggcggacgggtgagtaacgcgtgggtaacctgcccataagttggggataactccgggaaaccggtgctaataccgaataagcttaatttaccgcatggtagattaagtaaagatggcctctttacaatgctatcgcttatggatggacccgcgtctgattagctagttggtgaggtaatggctcaccaaggcgacgatcagtagccggcctgagagggtgaacggccacactgggactgagacacggcccagactcctacgggaggcagcagtggggaatcttccgcaatgggcgaaagcctgacggagcaatgccgcgtgagtgatgaaggccttcgggttgtaaaactctgtcctaatggaagaaaggctatggtgcaaatagtgccatagattgacggtacattgggaggaagccccggctaactacgtgccagcagccgcggtaatacgtagggggcaagcgttgtccggaattactgggcgtaaagagcgtgtaggcggatttttaagtcaggtgtgaaaactttgggcttaacccagagactgcatctgatactggaagtcttgagtgcaggagaggagagtggaattcctagtgtagcggtgaaatgcgtagatattaggaggaacaccagtggcgaaggcgactctctggactgtaactgacgctgagacgcgaaagcgtggggagcgaacaggattagataccctggtagtccacgccgtaaacgatgggtactaggtgttggggggtcaaagcctcagtgccgcagttaacacattaagtaccccgcctggggagtacggtcgcaagactgaaactcaaaggaattgacggggacccgcacaagcggtggagcatgtggtttaattcgacgcaacgcgaagaaccttaccaagacttgacatccctttgaccgctctttaatcggagctttccttcgggacaaaggtgacaggtggtgcatggttgtcgtcagctcgtgtcgtgagatgttgggttaagtcccgcaacgagcgcaacccttacttctagttgccatcattaagttgggcactctagagggactgccggtgataaaccggaggaaggtggggatgacgtcaaatcatcatgccccttatgtcttgggctacacacgtgctacaatggacagtacaaagggcagcaaagccgcgaggccaagcaaatcccaaaaagctgttctcagttcggattgcaggctgcaactcgcctgcatgaagtcggaatcgctagtaatcgcaggtcagcatactgcggtgaatacgttcccgggtcttgtacacaccgcccgtcacaccacgaaagttggtaacacccgaagccggtgatctaaccttagggaagaagccgtcgaaggtgggatcaatgattggggtgaagtcgtaacaaggtagccgtatcggaaggtgcggctggatcacctcctttctaa

SEQ ID NO: 3197 - DNA, 1071 bp, Desulfopila aestuarii
  ref <308>: DATABASE ACCESSION NUMBER: NCBI ACCESSION: NZ_FRFE01000100.1
  ref <309>: DATABASE ENTRY DATE: 2019-04-01
  ref <313>: RELEVANT RESIDUES IN SEQ ID NO: (1)..(1071)
aaactggagagtttgatcctggctcagaacgaacgctggcggcgtgcttaacacatgcaagtcgaacgcgaacgagttcttcggaactttagtagagtggcgcacgggtgagtaacgcgtaagtaatctaccctggcatctggaataacccaccgaaaggtgtgctaataccggatacgctgatttatcaggaaaggtggcctcttcatgaaagctactgtgctgggaggagcttgcgtaccattagctagttggtggggtaatggcctaccaaggcgacgatggttagcgggtctgagaggatgatccgccacactggaactggaacacggaccagactcctacgggaggcagcagtgaggaatattgcgcaatgggggaaaccctgacgcagcgacgccgcgtggatgatgaaggccttcgggtcgtaaaatcctgtcagatggaaagaaatgccagatgtctaatatatgtctggtttgacggtaccatcaaaggaagcaccggctaactccgtgccagcagccgcggtaatacggagggtgcaagcgttgttcggaattactgggcgtaaagcgcgcgtaggcggctatttaagtcagatgtgaaagtccacggctcaaccgtggaagtgcatttgatactgggtagcttgagtactggaggggatggtggaattcccggtgtagaggtgaaattcgtagatatcgggaggaataccggtggcgaaggcgaccatctggccagatactgacgctgaggtgcgaaagcgtggggagcaaacaggattagataccctggtagtccacgccgtaaacgatgtgaactaggtgttgggatggttaatcgtctcattgccgcagctaacgcattaagttcaccgcctggggagtacggtcgcaagattaaaactcaaaggaattgacgggggcccgcacaagcggtggagtatgtggtttaattcgacgcaacgcgcagaaccttacctggtcttgacatctcgggaatctctctgaaaggagagagtgctcttcggagagcccgatgacaggtgctgcatggctgtcgtca

SEQ ID NO: 3198 - DNA, 1552 bp, Desulforegula conservatrix
  ref <308>: DATABASE ACCESSION NUMBER: NCBI ACCESSION: NZ_AUEY01000125.1
  ref <309>: DATABASE ENTRY DATE: 2019-04-01
  ref <313>: RELEVANT RESIDUES IN SEQ ID NO: (1)..(1552)
ttaattggagagtttgatcctggctcagaatgaacgctggcggcgtgcttaacacatgcaagtcgtacgcgaaaggcgctttcgggtgccgagtagagtggcgcacgggtgagtaacgcgtgggtaatctacccttggatcttggataacatatcgaaaggtgtgctaatacgggatgaagtctatgtgaatgagtttatgtagatgaaaggccgcgcaagcggttgtccgaggatgagcctgcgtcccattagctagttggcggggtaaaggcccaccaaggctgagatgggtagctggtctgagaggatgatcagccacactggaactggaacacggtccagactcctacgggaggcagcagtgaggaattttgcgcaatgggggcaaccctgacgcagcaacgccgcgtgagtgatgaaggccttcgggtcgtaaagctctgtcgagtgggaagaaacagttcaggttaatatcctgaaccttgacggtaccactaaaggaagcaccggctaactccgtgccagcagccgcggtaatacggggggtgcaagcgttattcggaattattgggcgtaaagggtgcgtaggcggttttgtaagtcagatgtgaaatcccggggcttaacttcggaactgcatttgatactgcaagacttgagtatgggagaggagagcggaattcctggtgtagaggtgaaattcgtagatatcaggaggaacaccggtggcgaaggcggctctctggaccaatactgacgctgaggcacgaaggcgtggggagcaaacaggattagataccctggtagtccacgcagtaaacgttgatcacttggtgttgcgggtattgacccctgcggcgccgtagctaacgcgttaagtgatccgcctggggagtacggtcgcaagattaaaactcaaaggaattgacgggggcccgcacaagcggtggagcatgtggtttaattcgacgcaacgcgaagaaccttacctggacttgacatctgtggaatccttatgaaagtagggagtgcccttcggggagccgcaagacaggtgctgcatggctgtcgtcagctcgtgtcgtgagatgttgggttaagtcccgcaacgagcgcaacccttgtcttcagttaccatcattaagttgggaactctggagaaactgccccggttaacggggaggaaggtggggatgacgtcaagtcctcatggcccttatgtccagggctacacacgtgctacaatggtatgtacaaagggtagcaagcctgcgagggtgagccaatcccataaagcatacctcagttcggattgcagtctgcaactcgactgcatgaagttggaatcgctagtaatcgcggatcagcatgccgcggtgaatacgttcccgggccttgtacacaccgcccgtcacaccatgagagttggttgtaccagaagtcgttgggctaaccgtaaggaggcaggcgcctaaggtatgattgataattggggtgaagtcgtaacaaggtagccgttggggaaccagcggctggatcacctcctttct

SEQ ID NO: 3199 - DNA, 1567 bp, Desulfosarcina cetonica
  ref <308>: DATABASE ACCESSION NUMBER: NCBI ACCESSION: NZ_BBCC01000292.1
  ref <309>: DATABASE ENTRY DATE: 2019-04-01
  ref <313>: RELEVANT RESIDUES IN SEQ ID NO: (1)..(1567)
tttaattggagagtttgatcctggctcagaatgaacgctggcggcgtgcttaacacatgcaagtcgtacgagaacactctagcttgctagggtaagtaaagtggcgcacgggtgagtaacgcgtgggtaacctaccttcgaattggggataacgttgcgaaagcgacgctaataccgaatgatatcgaatgatcctcggagcattcgatcaagggtggcctcttcatgaaagctactgtttgaagatgggcccgcgtaccattagcttgttggtggggtaatggcctaccaaggcgacgatggttagctggtctgagaggatgatcagccacactggaactgacacacggtccagactcctacgggaggcagcagtgaggaattttgcgcaatgggcgaaagcctgacgcagcaacgccgcgtgagtgatgaaggccttcgggtcgtaaagctctgtcaagtgggaagaacctatataatgttaataccattatatactgacggtaccactgaaggaagcaccggctaactccgtgccagcagccgcggtaatacggggggtgcaagcgttattcggaatcattgggcgtaaagagcacgtaggcggcctggtaagtcagatgtgaaagcccggggcttaacctcggaagtgcatttgatactgtcaggcttgagtatgggagagggaagtggaattcctggtgtagaggtgaaattcgtagatatcaggaggaacaccggtggcgaaggcgacttcctggaccaatactgacgctgaggtgcgaaggcgtgggtagcaaacaggattagataccctggtagtccacgcagtaaacgttgatcactaggtgtagcgggtattgacccctgctgtgccgcagttaacgcattaagtgatccgcctggggagtacggtcgcaagattaaaactcaaaggaattgacgggggcccgcacaagcggtggagcatgtggtttaattcgacgcaacgcgaagaaccttacctggatttgacatcccgggaatcctatcgaaagactggagtgcccttcggggagcccggagacaggtgctgcatggctgtcgtcagctcgtgtcgtgagatgttgggttaagtcccgcaacgagcgcaacccttgtctttagttaccatcatttagttggggactctaaagatactgccccggtcaacggggaggaaggtggggatgacgtcaagtcctcatggcctttatgtccagggctacacacgtgctacaatgggcggtacaaagggtcgcgaacccgcgagggtaagccaatcccaaaaagccgtcccaagttcggattggagtctgcaactcgactccatgaagctggaatcgctagtaatcgcggatcagcatgccgcggtgaatacgttcccgggccttgtacacaccgcccgtcacaccatgagagttggttgtaccagaagtcgtcgggctaacccttcggggatgcaggcgcctaaggtatggctgataattagggtgaagtcgtaacaaggtagccgttggggaaccagcggctggatcacctcctttct

SEQ ID NO: 3200 - DNA, 1568 bp, Desulfosarcina sp. BuS5
  ref <308>: DATABASE ACCESSION NUMBER: NCBI ACCESSION: NZ_AXAM01000010.1
  ref <309>: DATABASE ENTRY DATE: 2019-04-01
  ref <313>: RELEVANT RESIDUES IN SEQ ID NO: (1)..(1568)
taattggagagtttgatcctggctcagaatgaacgctggcggcgtgcttaacacatgcaagtcgtacgagaactctttagcttgctaaagatagtaaagtggcgtacgggtgagtaacgcgtgggtaatctacccctgaatctgggataacattgcgaaagcgatgctaataccggataatatctgaattagaactctttttcagatcaaaggtggcctctataaataagctactgttttgggatgagcccgcgtaccattagctagttggtagggtaatggcctaccaaggcaacgatggttagctggtctgagaggatgatcagccacactggaactgacacacggtccagactcctacgggaggcagcagtgaggaattttgcgcaatgggggaaaccctgacgcagcaacgccgcgtgagtgatgaaggctttcgggtcgtaaagctctgtcgagtgggaagaacaaaaaaggttataatacacctttttctgacggtaccaccaaaggaagcaccggctaactccgtgccagcagccgcggtaacacggggggtgcaagcgttattcggaattattgggcgtaaagggcgcgcaggcggtttcttaagtcagatgtgaaagcccggggcttaaccccggaagggcgtttgaaactaagtaacttgagtatgggagagggaagtggaattcctggtgtagaggtgaaattcgtagatatcaggaggaacaccagtggcgaaggcgacttcctggaccaatactgacgctgaggcgcgaaggcgtggggagcgaacaggattagataccctggtagtccacgcagtaaacgatgaacactaggtgtagcgggtattgactcctgctgtgccgcagttaacgcattaagtgttccgcctggggagtacggtcgcaaggttaaaactcaaaggaattgacgggggcccgcacaagcggtggagcatgtggtttaattcgacgcaacgcgaagaaccttacctggatttgacatcccgggaatttttcgaaagaaaaaagtgcccttcggggaacccggagacaggtgctgcatggctgtcgtcagctcgtgtcgtgagatgttgggttaagtcccgcaacgagcgcaacccctatctttagttaccatcattaagttggggactctaaagatactgccccggttaacggggaggaaggtggggatgacgtcaagtcctcatggcctttatatccagggctacacacgtgctacaatgggctgtacaaagggtcgcgaactcgcaagagtaagccaatcccataaagcagtccctagttcggattggagtctgcaactcgactccatgaagctggaatcgctagtaatcgtggatcagcatgccacggtgaatacgttcccgggccttgtacacaccgcccgtcacaccatgagagttgattgtaccagaagttgttggaccaacccgcaaggggggtaggcacctaaggtatggttgataattagggtgaagtcgtaacaaggtagccgttggggaaccagcggctggatcacctcctttctaagga

SEQ ID NO: 3201 - DNA, 1555 bp, Desulfosoma caldarium
  ref <308>: DATABASE ACCESSION NUMBER: NCBI ACCESSION: NZ_RJVA01000004.1
  ref <309>: DATABASE ENTRY DATE: 2019-04-01
  ref <313>: RELEVANT RESIDUES IN SEQ ID NO: (1)..(1555)
aaactggagagtttgatcctggctcagaatgaacgctggcggcgtgcctaacacatgcaagtcgcacgagaaaggctggggcaacttggccgagtaaagtggcgcacgggtgagtaacgcgtgggtgacctaccctcgaatctgggataaccttgcgaaagtggggctaataccggatacgtttccttatggggaaagaaagccggcctctcgaagaagctggtgttcggggatgggcccgcgtcctatcagctagttggtagggtaacggcctaccaaggcgacgacgggtagctggtctgagaggatggccagccacactggcactggaacacgggccagactcctacgggaggcagcagtgaggaattttgcgcaatgggagaaatcctgacgcagcaacgccgcgtgggtgatgaaggccttcgggtcgtaaagccctgtcaggggggaagaagctcttataggcgaagagcctatgggattgacggtaccctcagaggaagcaccggctaactccgtgccagcagccgcggtaatacggagggtgcgagcgttattcggaattactgggcgtaaagcgcgcgtaggcggtggggcaagtctggtgtgaaagcccggggcttaacctcggaagggcattggaaactgcctcacttgagtgccggagaggaagggggaattcccggtgtagcggtgaaatgcgtagatatcgggaggaataccggtggcgaaggcgtccttctggaaggcaactgacgctgaggcgcgaaagcgtggggagcaaacaggattagataccctggtagtccacgccgtaaacgatgggcactaggtgtagcgggtattgacccctgctgtgccgaagctaacgcgttaagtgccccgcctggggagtacggccgcaaggttaaaactcaaaggaattgacgggggcccgcacaagcggtggagcatgtggtttaattcgaagcaacgcgaagaaccttacctgggcttgacatcccgagaaccctgctgaaaggtgggggtgcccttcggggagctcggagacaggtgctgcatggctgtcgtcagctcgtgtcgtgagatgttgggttaagtcccgcaacgagcgcaacccctgcctctagttgccagcactttgggtgggcactctagagggactgccggtgtcaaaccggaggaaggtggggacgacgtcaagtcctcatggcctttatgcccagggctacacacgtgctacaatgggcggtacaaagggcagcgaacccgtgagggggagccaatcccaaaaagccgtccccagttcggatcggagtctgcaactcgactccgtgaaggcggaatcgctagtaatcgcggatcagcatgccgcggtgaatacgttcccgggccttgtacacaccgcccgtcacaccacgaaagtcggctgtaccagaagtgcgtgggcgaacccttttgggacgcagcgtaccaaggtatggtcggtaattggggtgaagtcgtaacaaggtagccgtaggggaacctgcggctggatcacctcctttct

SEQ ID NO: 3202 - DNA, 560 bp, Desulfospira joergensenii
  ref <308>: DATABASE ACCESSION NUMBER: NCBI ACCESSION: NZ_ATUG01000001.1
  ref <309>: DATABASE ENTRY DATE: 2019-04-01
  ref <313>: RELEVANT RESIDUES IN SEQ ID NO: (1)..(560)
taactggagagtttgatcctggctcagaatgaacgctggcggcgtgcttaacacatgcaagtcgaacgagaaagggattgcttgcaatcctgagtagagtggcgcacgggtgagtaacacgtagataatctacccacaagcccggaataactattcgaaaggatagctaataccggatgaagtttgtttacacaagtagacaaatgaaagattgcctcttcctgaaagcaattgtttgtggatgagtttgcggaccattagcttgttggtggggtaaaggcccaccaaggctgcgatggttagctggtctgagaggatgatcagtcacactggaactggaacacggtccagactcctacgggaggcagcagtgaggaattttgcgcaatgggggcaaccctgacgcagcaacgccgcgtgagtgaagaaggcctttgggtcgtaaagctctgtcaacaaggaagaagttaagattgtttaatagatgatcttattgacggtacttgtggaggaagcgccggctaactccgtgccagcagccgcggtaacacggggggcgc

SEQ ID NO: 3203 - DNA, 1474 bp, Desulfosporosinus acididurans
  ref <308>: DATABASE ACCESSION NUMBER: NCBI ACCESSION: NZ_LDZY01000010.1
  ref <309>: DATABASE ENTRY DATE: 2019-04-01
  ref <313>: RELEVANT RESIDUES IN SEQ ID NO: (1)..(1474)
ttttttggagagtttgatcctggctcaggacgaacgctggcggcgtgcttaacacatgcaagtcgaacggagagaattctaagtttacttagaaggatcttagtggcggacgggtgagtaacgcgtgggtaacctacccaacaaactgggacaacccttggaaacgagggctaataccggatacgcttataggttggcatcaacgtataaggaaaggcggcctctgaatatgctgccgatgatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtttttagggaagaacggtttcttcaggaatatggaggagacatgacggtacctaaggaggaagccccggctaactacgtgccagcagccgcggtaatacgtagggggcgagcgttgtccggaattattgggcgtaaagggcgcgtaggcgggtatttaagtccggtgtgaaagatcagggctcaaccctgagagtgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagggggtatcgacccctcctgtgccggagttaacacaataagcactccgcctggggagtacggccgcaaggttgaaactcaaaggaattgacgggggcccgcacaagcggtggagcatgtggtttaattcgacgcaacgcgaagaaccttaccagggcttgacatcctctgaaccctttggaaacaagggggtgcctttcggggaacagagagacaggtggtgcatggttgtcgtcagctcgtgtcgtgagatgttgggttaagtcccgcaacgagcgcaacccctgtattcagttgctaacaagtaaggttgagcactctggatagactgccggtgacaaaccggaggaaggtggggatgacgtcaaatcatcatgccccttatgtcctgggctacacacgtgctacaatggccggtacagacggaagcgaagccgtgaggtgaagccaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccg

SEQ ID NO: 3204 - DNA, 773 bp, Desulfosporosinus lacus
  ref <308>: DATABASE ACCESSION NUMBER: NCBI ACCESSION: NZ_FQXJ01000002.1
  ref <309>: DATABASE ENTRY DATE: 2019-04-01
  ref <313>: RELEVANT RESIDUES IN SEQ ID NO: (1)..(773)
tggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaatgactgatttgaaaatattgagtcagtatgacggtacccaaggaggaagccccggctaactacgtgccagcagccgcggtaatacgtagggggcaagcgttgtccggaattattgggcgtaaagggcgcgtaggcggatttttaagtctggtgtgaaagatcagggctcaaccctgagagtgcatcggaaactggagatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgctgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatcc

SEQ ID NO: 3205 - DNA, 1407 bp, Desulfosporosinus sp. BG
  ref <308>: DATABASE ACCESSION NUMBER: NCBI ACCESSION: NZ_MASS01000130.1
  ref <309>: DATABASE ENTRY DATE: 2019-04-01
  ref <313>: RELEVANT RESIDUES IN SEQ ID NO: (1)..(1407)
ttagtggcggacgggtgagtaacgcgtgggtaacctacccataaacccgggacaacccttggaaacgagggctaataccgaataatcttaaggagtggcatcactttttaaggaaaggtggcctctgagaatgctaccgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaacgacgggcttgaaaatattgagttcgtatgacggtacccaaggaggaagccccggctaactacgtgccagcagccgcggtaatacgtagggggcaagcgttgtccggaattattgggcgtaaagggcgcgtaggcggatcattaagtccggtgtgaaagatcagggctcaaccctgagagtgcatcggaaactggtgatcttgaggacaggagaggaaagtggaattcctagtgtagcggtgaaatgcgtagatattaggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccagggcttgacatctacagaatccttaggaaactagggagtgcccttcggggagctgtaagacaggtggtgcatggttgtcgtcagctcgtgtcgtgagatgttgggttaagtcccgcaacgagcgcaacccctgtgtttagttgctaacgagtaaggtcgagcactctagacagactgccggtgataaaccggaggaaggtggggatgacgtcaaatcatcatgccccttatgttctgggctacacacgtgctacaatggccggtacagacggaagcgaagccgcgaggtgaagccaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgcaagggagctagccgtcgaaggtggggccgat

SEQ ID NO: 3206 - DNA, 1482 bp, Desulfosporosinus sp. HMP52
  ref <308>: DATABASE ACCESSION NUMBER: NCBI ACCESSION: NZ_JMGA01000027.1
  ref <309>: DATABASE ENTRY DATE: 2019-04-01
  ref <313>: RELEVANT RESIDUES IN SEQ ID NO: (1)..(1482)
aaaaattcttagtggcggacgggtgagtaacgcgtgggtaacctacccataaatccgggacaacccttggaaacgagggctaataccggataatcttaaagcttggcatcaaggtttaaggaaagatggcctctgaacatgctatcgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaacggtcgatttgagaatattgagtcgacatgacggtacccaaggaggaagccccggctaactacgtgccagcagccgcggtaatacgtagggggcaagcgttgtccggaattattgggcgtaaagggcgcgtaggcggattattaagtctggtgtgaaagatcagggctcaaccctgagagtgcatcggaaactggtgatcttgaggacaggagaggaaagtggaattccacgtgtagcggtgaaatgcgtagatatgtggaggaacaccggtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctacgaatccttaggaaactagggagtgcccttcggggagcgtagagacaggtggtgcatggttgtcgtcagctcgtgtcgtgagatgttgggttaagtcccgcaacgagcgcaacccctgtatttagttgctaacgagtaatgttgagcactctagatagactgccggtgataaaccggaggaaggtggggatgacgtcaaatcatcatgccccttatgtcttgggctacacacgtgctacaatggccggtacagacggaagcgaagccgcgaggtgaagcaaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacccgaaagggagctagccgtcgaaggtggggccgataattggggtgaagtcgtaacaaggtagccgtatcggaaggtgcggctggatcacctcctttctaagg

SEQ ID NO: 3207 - DNA, 1371 bp, Desulfosporosinus sp. I2
  ref <308>: DATABASE ACCESSION NUMBER: NCBI ACCESSION: NZ_JYNH01000275.1
  ref <309>: DATABASE ENTRY DATE: 2019-04-01
  ref <313>: RELEVANT RESIDUES IN SEQ ID NO: (1)..(1371)
agtggcggacgggtgagtaacgcgtgggtaacctacccataaagccgggacaacccttggaaacgagggctaataccggataatcttaaggcttggcatcaagctttaaggaaaggtggcctctgaaaatgctaccgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaatgacggatttgaaaatattgagtccgtatgacggtacccaaggaggaagccccggctaactacgtgccagcagccgcggtaatacgtagggggcaagcgttgtccggaattattgggcgtaaagggcgcgtaggcgggtatttaagtctggtgtgaaagatcagggctcaaccctgagagtgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccaaggcttgacatcctacgaattctttggaaacaagggagtgcccttcggggagcgtagagacaggtggtgcatggttgtcgtcagctcgtgtcgtgagatgttgggttaagtcccgcaacgagcgcaacccctgtgtttagttgctaacgcgtaatggcgagcactctagacagactgccggtgataaaccggaggaaggtggggatgacgtcaaatcatcatgccccttatgtcttgggctacacacgtgctacaatggccggtacagacggacgcaaagccgcgaggtggagcaaatccgagaaagccggtctcagttcggattgcaggctgcaactcgcctgcatgaagtcggaatcgctagtaatcgcaggtcagcatactgcggtgaatacgttcccgggccttgtacacaccgcccgtcacaccacgaaagtctgcaacacccgaagccggtgaggtaacc

SEQ ID NO: 3208 - DNA, 1022 bp, Desulfosporosinus sp. OL
  ref <308>: DATABASE ACCESSION NUMBER: NCBI ACCESSION: NZ_MLBF01000156.1
  ref <309>: DATABASE ENTRY DATE: 2019-04-01
  ref <313>: RELEVANT RESIDUES IN SEQ ID NO: (1)..(1022)
ttttttggagagtttgatcctggctcaggacgaacgctggcggcgtgcctaacacatgcaagtcgaacggagaatttcaataagcttgcttagcgaaatttttagtggcggacgggtgagtaacgcgtgggtaacctacccataaagccgggacaacccttggaaacgagggctaataccggatacccttatagagtggcatcactgtataagaaaaggtggcctctgaagatgctaccgattatggatggacccgcgtctgattagctagttggtggggtaaaggcctaccaaggcgacgatcagtagccggcctgagagggtgaacggccacactgggactgagacacggcccagactcctacgggaggcagcagtggggaatcttccgcaatggacgaaagtctgacggagcaacgccgcgtgtatgatgaaggtcttcggattgtaaagtactgtctttggggaagaacggtgggtttgagaatattgagtccacatgacggtacccaaggaggaagccccggctaactacgtgccagcagccgcggtaatacgtagggggcaagcgttgtccggaattattgggcgtaaagggcgcgtaggcggatgcttaagtccggtgtgaaagatcagggctcaaccctgagagtgcatcggaaactgggtatcttgaggacaggagaggaaagtggaattccacgtgtagcggtgaaatgcgtagatatgtggaggaacaccagtggcgaaggcgactttctggactgtaactgacgctgaggcgcgaaagcgtggggagcaaacaggattagataccctggtagtccacgccgtaaacgatgagtgctaggtgtagagggtatcgaccccttctgtgccgcagttaacacaataagcactccgcctggggagtacggccgcaaggttgaaactcaaaggaattgacgggggcccgcacaagcggtggagcatgtggtttaattcgacgcaacgcgaagaaccttaccagggcttgacatcct

SEQ ID NO: 3209 - DNA, 1550 bp, Desulfotalea psychrophila
  ref <308>: DATABASE ACCESSION NUMBER: NCBI ACCESSION: NC_006138.1
  ref <309>: DATABASE ENTRY DATE: 2019-04-01
  ref <313>: RELEVANT RESIDUES IN SEQ ID NO: (1)..(1550)
aaactggagagtttgatcctggctcagaacgaacgctggcggcgtgcttaacacatgcaagtcgaacgcgaacgagtttttcgaaactctagtagagtggcgcacgggtgagtaacgcgtaagtaatctaccctgatatctgggataacaattcgaaaggattgctaataccggatacgttgatttatcaagaaagatggcctcttcatgaaagctattgtatcgggaggagcttgcgtaccattagctagttggtggggtaatggcctaccaaggcgacgatggttagcgggtctgagaggatgatccgccacactggaactgaaacacggaccagactcctacgggaggcagcagtgaggaatattgcgcaatgggggaaaccctgacgcagcgacgccgcgtggatgatgaaggccttcgggtcgtaaaatcctgtcagatgggaagaaatggtaatgagctaatacctcgttactttgacggtaccatcaaaggaagcaccggctaactccgtgccagcagccgcggtaatacggggggtgcaagcgttgttcggaattactgggcgtaaagcgcgcgtaggcggctttttaagtcagatgtgaaagtcctcggctcaaccgaggaagtgcatttgaaactggggagcttgagtactggaggggatggtggaattcccggtgtagaggtgaaattcgtagatatcgggaggaataccggtggcgaaggcgaccatctggccagatactgacgctgaggtgcgaaagcgtggggagcaaacaggattagataccctggtagtccacgccgtaaacgatgtcaactaggtgttggagtggttaatcgcttcattgccggagctaacgcattaagttgaccgcctggggagtacggtcgcaagattaaaactcaaaggaattgacgggggcccgcacaagcggtggagtatgtggtttaattcgacgcaacgcgcagaaccttacctggtcttgacatctcggaaatctcttggaaacaggagagtgcctcttgaggaatccgatgacaggtgctgcatggctgtcgtcagctcgtgtcgtgagatgttgggttaagtcccgcaacgagcgcaacccctgtctctagttgccatcattaagttgggcactctagagagactgccggtgtcaaaccggaggaaggtagggatgacgtcaagtcctcatggcctttatgaccagggctacacacgtactacaatggcatagacaaagggcagcaacacagcgatgtgaagccaatcccataaactatgtctcagtccggattggagtctgcaactcgactccatgaagttggaatcgctagtaatcgtagatcagcatgctacggtgaatacgttcccgggccttgtacacaccgcccgtcacaccacgggagttggttgtaccagaagcagttgagctaacccttcgggggggcaggctgccaaggtatggctggtaactggggtgaagtcgtaacaaggtagccctaggggaacctggggctggatcacctccttttta

SEQ ID NO: 3210 - DNA, 1585 bp, Desulfotignum balticum
  ref <308>: DATABASE ACCESSION NUMBER: NCBI ACCESSION: NZ_ATWO01000001.1
  ref <309>: DATABASE ENTRY DATE: 2019-04-01
  ref <313>: RELEVANT RESIDUES IN SEQ ID NO: (1)..(1585)
tttaactggagagtttgatcctggctcagaatgaacgctggcggcgtgcttaacacatgcaagtcgaacgagaaagggattgcttgcaatcctgagtagagtggcgcacgggtgagtaacacgtagataatctaccttcaagcccgggataacccttcgaaaggatggctaataccggatgcagtttcagtacacaagtactgagatgaaagattgcctcttcttgaaagcaattgtttggagatgagtttgcgtaccattagcttgttggtggggtaaaagcctaccaaggctgcgatggttagctggtctgagaggatgatcagtcacactggaactggaacacggtccagactcctacgggaggcagcagtgaggaattttgcgcaatgggggaaaccctgacgcagcaacgccgcgtgagtgaagaaggcccttgggtcgtaaagctctgtcaactgggaagaagttgttattgtttaataaatgatagcattgacggtaccagtggaggaagcgccggctaactccgtgccagcagccgcggtaacacggggggcgcaagcgttattcggaattattgggcgtaaagggcgcgtaggcggttctgtcggtcagatgtgaaagcccggggctcaaccctggaagtgcatttgaaacagcagaacttgagtacgggagaggaaagcggaattcctggtgtagaggtgaaattcgtagatatcaggaggaacaccgatggcgaaggcagctttctggaccgatactgacgctgaggcgcgaaggcgtgggtagcgaacaggattagataccctggtagtccacgcagtaaacgatgttcactaggtgtagcggatattaaaatctgctgtgccgcagctaacgcattaagtgaaccgcctgggaagtacggtcgcaagactaaaactcaaaggaattgacgggggcccgcacaagcggtggagcatgtggtttaattcgacgcaacgcgaagaaccttacctgggtttgacatcctgtgaatcttcaagagattgaagagtgccttcgggagcacagagacaggtgctgcatggctgtcgtcagctcgtgtcgtgagatgtttggttaagtccagcaacgagcgcaacccttatcgtcagttgccagcgcgtaatggcgggaactctggcgagactgccccggttaacggggaggaaggtggggatgacgtcaagtcctcatggcccttatatccagggctacacacgtgctacaatggtaggtacaaagggcagcgaacccgcgagggtgagcgaatcctcaaagcctatctcagtccggattggagtctgcaactcgactccatgaagttggaatcgctagtaatcgcggatcagcatgccgcggtgaatatgttcccgggccttgtacacaccgcccgtcacaccatggaagttgattatacccgacgtcgccgggctaacttccctttctttatagattgggcagaggcaggcgcctaaggtatggttgataactggggtgaagtcgtaacaaggtagccgttgaggaatcagcggctggatcacctcctttctaagga

SEQ ID NO: 3211 - DNA, 1585 bp, Desulfotignum phosphitoxidans
  ref <308>: DATABASE ACCESSION NUMBER: NCBI ACCESSION: NZ_APJX01000002.1
  ref <309>: DATABASE ENTRY DATE: 2019-04-01
  ref <313>: RELEVANT RESIDUES IN SEQ ID NO: (1)..(1585)
tttaactggagagtttgatcctggctcagaatgaacgctggcggcgtgcttaacacatgcaagtcgaacgagaaagggattgcttgcaatcctgagtagagtggcgcacgggtgagtaacacgtagataatctaccttcaagcccgggataacccttcgaaaggatggctaataccggatgcagtttcagtacacaagtgctgagatgaaagattgcctcttcttgaaagcaattgtttggagatgagtttgcgtaccattagcttgttggtggggtaaaagcctaccaaggctgcgatggttagctggtctgagaggatgatcagtcacactggaactggaacacggtccagactcctacgggaggcagcagtgaggaattttgcgcaatgggggaaaccctgacgcagcaacgccgcgtgagtgaagaaggcccttgggtcgtaaagctctgtcaactgggaagaagttgttattatttaataaatgatagcattgacggtaccagtggaggaagcgccggctaactccgtgccagcagccgcggtaacacggggggcgcaagcgttattcggaattattgggcgtaaagggcgcgtaggcggttctgtcggtcagatgtgaaagcccggggctcaaccctggaagtgcatttgaaacagcagaacttgagtacgggagaggaaagcggaattcctggtgtagaggtgaaattcgtagatatcaggaggaacaccgatggcgaaggcagctttctggaccgatactgacgctgaggcgcgaaggcgtgggtagcgaacaggattagataccctggtagtccacgcagtaaacgatgttcactaggtgtagcggatattaaaatctgctgtgccgcagctaacgcattaagtgaaccgcctgggaagtacggtcgcaagactaaaactcaaaggaattgacgggggcccgcacaagcggtggagcatgtggtttaattcgacgcaacgcgaagaaccttacctgggtttgacatcctgtgaatcttcaagagattgaagagtgccttcgggagcacagagacaggtgctgcatggctgtcgtcagctcgtgtcgtgagatgtttggttaagtccagcaacgagcgcaacccttatcgtcagttgccagcgcgtaatggcgggaactctggcgagactgccccggttaacggggaggaaggtggggatgacgtcaagtcctcatggcccttatatccagggctacacacgtgctacaatggtaggtacaaagggcagcgaacccgcgagggtgagcgaatcctcaaagcctatctcagtccggattggagtctgcaactcgactccatgaagttggaatcgctagtaatcgcggatcagcatgccgcggtgaatatgttcccgggccttgtacacaccgcccgtcacaccatggaagttgattatacccgacgtcgctgggctaacttccctttctttatagattgggcagaggcaggcgcctaaggtatggttgataactggggtgaagtcgtaacaaggtagccgttgaggaatcagcggctggatcacctcctttctaagga

SEQ ID NO: 3212 - DNA, 1248 bp, Desulfotomaculum aeronauticum
  ref <308>: DATABASE ACCESSION NUMBER: NCBI ACCESSION: NZ_FRAR01000003.1
  ref <309>: DATABASE ENTRY DATE: 2019-04-01
  ref <313>: RELEVANT RESIDUES IN SEQ ID NO: (1)..(1248)
tagccggcctgagagggcgaacggccacactgggactgagacacggcccagactcctacgggaggcagcagtggggaatcttccgcaatgggcgaaagcctgacggagcaacgccgcgtgagggaagaaggccttcgggttgtaaacctctgttttcagggaagaaagaaatgacggtacctgaagagtaagccccggctaactacgtgccagcagccgcggtaaaacgtagggggcaagcgttgtccggaattactgggcgtaaagggcgcgtaggtggttcattaagttataggtgaaagttcggggctcaaccccgtgattgcctgtgatactggtggacttgagtgcaggagagggtagcagaattcccagtgtagcggtgaaatgcgtagatattgggaggaataccagtggcgaaggcggctatctggactgtaactgacactgaggcgcgaaagcgtggggagcaaacaggattagataccctggtagtccacgccgtaaacgatgagtgctaggtgttgcgggtatcgacccctgcagtgccgtagttaacacaataagcactccgcctggggagtacggtcgcaagactgaaactcaaaggaattgacgggggcccgcacaagcggtggagtatgtggtttaattcgacgcaacgcgaagaaccttaccagggcttgacatcgcatgaaagctctagagatagagtgttctgccttcgggcagacatgtagacaggtggtgcatggttgtcgtcagctcgtgtcgtgagatgttgggttaagtcccgcaacgagcgcaacccctaacattagttgccagcacgtaaaggtgggaactctaatgtgactgccgttgacaaaacggaggaaggtggggatgacgtcaaatcatcatgccccttatgtcctgggctacacacgtactacaatggccggtacagacggaagcgaagctgtgaagtggagcaaacctgagaaagccggtcccagttcggattgtagtctgcaactcgactacatgaagtcggaatcgctagtaatcgcaggtcagcatactgcggtgaatacgttcccgggccttgtacacaccgcccgtcacaccacgaaagctgacaacacccgaagccggtgacttaaccgaaaggagagagccgtcgaaggtggggttggtgattggggtgaagtcgtaacaaggtagccgtatcggaaggtgcggctggatcacctcctttctaaggag

SEQ ID NO: 3213 - DNA, 1513 bp, Desulfotomaculum copahuensis
  ref <308>: DATABASE ACCESSION NUMBER: NCBI ACCESSION: NZ_LYVF01000197.1
  ref <309>: DATABASE ENTRY DATE: 2019-04-01
  ref <313>: RELEVANT RESIDUES IN SEQ ID NO: (1)..(1513)
ttcatggagagtttgatcctggctcaggacgaacgctggcggcgtgcctaacacatgcaagtcgagcgggtaacggaagtcagtcatcggaggtcagaagccggataaagaagccaaaggccataggccgaaggcggaaacaatccgacatccgatttccgacgactgacctccgttgctagcggcggacgggtgagtaacacgtggataacctgcctgacagaccgggataacgccgggaaactggtgctaataccggataagctctttttcctgcatgggaggaagaggaaaggggaaacccgctgacagatgggtccgcggcccattagctggatggtggggtaacggcccaccatggcgacgatgggtagccggcctgagagggcgaccggccacactgggactgagacacggcccagactcctacgggaggcagcagtggggaatcttccgcaatgggcgcaagcctgacggagcaacgccgcgtgagcgaagaaggcctttgggtcgtaaagctctgttgttggggacgaaagaaatgacggtacccggcgaggaagccccggctaactacgtgccagcagccgcggtaagacgtagggggcgagcgttgtccggaattactgggcgtaaagggcgcgtaggcggcccgtgaagtcaggggtgaaataccgcggctcaaccgcgggggtgcccatgaaaccagcgggcttgagggcaggagaggggagcggaattcccagtgtagcggtgaaatgcgtagatattgggaggaacaccagtggcgaaggcggctctctggcctggccctgacgctgaggcgcgaaagcgtggggagcgaacaggattagataccctggtagtccacgccgtaaacgatgggtgctaggtgttgggggtatcgaccccctcagtgccgtagtaaacgcaataagcaccccgcctggggagtacggccgcaaggctgaaactcaaaggaattgacgggggcccgcacaagcggtggagcatgtggtttaattcgacgcaacgcgaagaaccttaccagggcttgacatcccctgacgggcatggaaacatgtcgtttaatcttcggattgacagggagacaggtggtgcatggttgtcgtcagctcgtgtcgtgagatgttgggttaagtcccgcaacgagcgcaacccctacagttagttgctaacggggaaagccgagcactctagctgaactgccgttgacaaaacggaggaaggcggggatgacgtcaaatcatcatgccccttatgttctgggctacacacgtgctacaatggtctgcacaaagggcagcgagcccgcgagggtaagcgaatcccggaaagcaggtctcagttcggattgcaggctgcaacccgcctgcatgaagtcggaatcgctagtaatcgcaggtcagcatactgcggtgaatacgttcccgggccttgtacacaccgcccgtcacaccacgaaagctgacaacacccgaagccggtgact

SEQ ID NO: 3214 - DNA, 1623 bp, Desulfotomaculum ferrireducens
  ref <308>: DATABASE ACCESSION NUMBER: NCBI ACCESSION: NZ_CP019698.1
  ref <309>: DATABASE ENTRY DATE: 2019-04-01
  ref <313>: RELEVANT RESIDUES IN SEQ ID NO: (1)..(1623)
ttatatggagagtttgatcctggctcaggacgaacgctggcggcgtgcctaacacatgcaagtcgaacggttctcgaggttcgacattcgaggttcgaagttcgagtgaacgcaagcctttggggtccttgagccgaaaggaatgcttgaatcgaaccacgaatttcgaacgtcgaacttcgaggatagtggcggacgggtgagtaacgcgtggataacctgcctggtagaccgggataacagctggaaacggctgctaataccggatacgctcgggagttcgcatgaacactcgaggaaagctttcgtgctatcagatgggtccgcgtcccattagctagttggtggtgtaaaggaccaccaaggcgacgatgggtagccggcctgagagggcgaccggccacactgggactgagacacggcccagactcctacgggaggcagcagtggggaatcttccgcaatgggcgaaagcctgacggagcaacgccgcgtgagggaagaaggccttcgggttgtaaacctctgtttttagggacgaaaaagatgacggtacctaaagagtaagctccggctaactacgtgccagcagccgcggtaatacgtagggagcgagcgttgtccggaattactgggcgtaaagggcgcgtaggtggtccattaagttactggtgaaagttcggggcttaaccccgtgattgcctgtaatactggtggacttgagtgcaggagaggggagtggaattcccagtgtagcggtgaaatgcgtagatattgggaggaacaccagtggcgaaggcggctctctggactgtaactgacactgaggcgcgaaagcgtggggagcaaacaggattagataccctggtagtccacgccgtaaacgatgagtgctaggtgttgcgggtatcgacccctgcagtgccgtagttaacacaataagcactccgcctggggagtacggtcgcaagactgaaactcaaaggaattgacgggggcccgcacaagcggtggagtatgtggtttaattcgacgcaacgcgaagaaccttaccagggcttgacatcctctgaaagccgtagagatacggtccttagtcttcggactaacagagagacaggtggtgcatggttgtcgtcagctcgtgtcgtgagatgttgggttaagtcccgcaacgagcgcaacccctaacattagttgccagcgaggtaggtcgggaactctaatgtgactgccgttgacaaaacggaggaaggtggggatgacgtcaaatcatcatgccccttatgtcctgggctacacacgtactacaatggccggtacagacggaggcgaagctgtgaagcggagcaaaactgagaaagccggtcccagttcggattgtagtctgcaactcgactacatgaagtcggaatcgctagtaatcgcaggtcagcatactgcggtgaatacgttcccgggccttgtacacaccgcccgtcacaccacgaaagctgacaacacccgaagccggtgacttaaccgcaaggagagagccgtcgaaggtggggttggtgattggggtgaagtcgtaacaaggtagccgtatcggaaggtgcggctggatcacctcctttctaagga

SEQ ID NO: 3215 - DNA, 523 bp, Desulfotomaculum hydrothermale
  ref <308>: DATABASE ACCESSION NUMBER: NCBI ACCESSION: NZ_FQXF01000002.1
  ref <309>: DATABASE ENTRY DATE: 2019-04-01
  ref <313>: RELEVANT RESIDUES IN SEQ ID NO: (1)..(523)
agatgacggtacttggagaggaagccccggctaactacgtgccagcagccgcggtaaaacgtagggggcgagcgttgtccggaattactgggcgtaaagggcgcgtaggtggttcattaagtcagaggtgaaagttcggggctcaaccccgtgattgcctctgatactggtggacttgagtgcaggagaggggagcggaattcccagtgtagcggtgaaatgcgtagatattgggaggaacaccagtggcgaaggcggctctctggactgtaactgacactgaggcgcgaaagcgtggggagcaaacaggattagataccctggtagtccacgccgtaaacgatgagtgctaggtgttggtggtatcgaccccaccagtgccgcagttaacacaataagcactccgcctggggagtacggtggcaacactgaaactcaaaggaattgacgggggcccgcacaagcggtggagtatgtggtttaattcgacgcaacgcgaagaaccttaccagggcttgacatc

SEQ ID NO: 3216 - DNA, 1629 bp, Desulfotomaculum reducens
  ref <308>: DATABASE ACCESSION NUMBER: NCBI ACCESSION: NC_009253.1
  ref <309>: DATABASE ENTRY DATE: 2019-04-01
  ref <313>: RELEVANT RESIDUES IN SEQ ID NO: (1)..(1629)
ttttacggagagtttgatcctggctcaggacgaacgctggcggcgtgcttaacacatgcaagtcgaacggtcttcgaggttcgacattcgaggttcgaattttgagttcgagtaaagcttaagggtcatttaaaagaccccaaagaaatgcttggatcgaatcacgaatttcgaacgtcgaacttcgaagatagtggcgaacgggtgagtaacgcgtggataacctgcctgatagaccgggataacagctggaaacggctgctaataccggatacgcttgcggagtcgcatggctctgcaaggaaagctattgtgctatcagatggatccgcgtcccattagctagttggtggtgtaacggaccaccaaggcgacgatgggtagccggcctgagagggcgaacggccacactgggactgagacacggcccagactcctacgggaggcagcagtggggaatcttccgcaatgggcgaaagcctgacggagcaacgccgcgtgagggaagaaggccttcgggttgtaaacctctgttttcagggaagaacaaatgacggtacctgaagagtaagctccggctaactacgtgccagcagccgcggtaatacgtagggagcgagcgttgtccggatttactgggcgtaaagggcgcgtaggtggtgcattaagttagaggtgaaagttcggggctcaaccccgtgattgcctctgatactggtggacttgagtgcaggagaggggagcagaattcccagtgtagcggtgaaatgcgtagatattgggaggaataccagtggcgaaggcggctctctggactgtaactgacactgaggcgcgaaagcgtggggagcgaacaggattagataccctggtagtccacgccgtaaacgatgagtgctaggtgttgcgggtatcgacccctgcagtgccgcagtaaacacaataagcactccgcctggggagtacggtcgcaagactgaaactcaaaggaattgacgggggcccgcacaagcggtggagtatgtggtttaattcgacgcaacgcgaagaaccttaccagggcttgacatcctacgaaactcatagagatatgagccttatccttcgggataacgtagagacaggtggtgcatggttgtcgtcagctcgtgtcgtgagatgttgggttaagtcccgcaacgagcgcaacccctaacattagttgccagcatgtaaaggtgggaactctaatgtgactgccgttgacaaaacggaggaaggtggggatgacgtcaaatcatcatgccccttatgtcctgggctacacacgtactacaatggccggtacagacggaagcgaagccgtgaggtggagcaaacctgagaaagccggtcccagttcggattgtagtctgcaactcgactacatgaagtcggaatcgctagtaatcgcaggtcagcatactgcggtgaatacgttcccgggccttgtacacaccgcccgtcacaccacgaaagttgacaacacccgaagccggtgagctaaccgcaaggaggcagccgtcgaaggtggggccgatgattggggtgaagtcgtaacaaggtagccgtatcggaaggtgcggctggatcacctcctttctaaggaga

SEQ ID NO: 3217 - DNA, 1541 bp, Desulfotomaculum ruminis
  ref <308>: DATABASE ACCESSION NUMBER: NCBI ACCESSION: NC_015589.1
  ref <309>: DATABASE ENTRY DATE: 2019-04-01
  ref <313>: RELEVANT RESIDUES IN SEQ ID NO: (1)..(1541)
ttttatggagagtttgatcctggctcaggacgaacgctggcggcgtgcttaacacatgcaagtcgaacggagtttaaaatgaaacctagtgatttttaaacttagtggcggacgggtgagtaacgcgtggataacctgccggatagaccgggataacagttggaaacgactgctaataccggatacgctcctaggaacgcatgttctaaggaggaaagatttatcgctaaccgatggatccgcgtcccattagctagttggaggtgtaacggacccccaaggcgacgatgggtagccggcctgagagggcgaacggccacactgggactgagacacggcccagactcctacgggaggcagcagtggggaatcttccgcaatgggcgaaagcctgacggagcaacgccgcgtgagggaagaaggctttcgggttgtaaacctctgtcttaagggaagaacaaaatgacggtaccttgagaggaagccccggctaactacgtgccagcagccgcggtaaaacgtagggggcgagcgttgtccggaattactgggcgtaaagggcgcgtaggtggtgcattaagttagaggtgaaagtgcggggcttaaccccgtgaggcctctgatactggtggacttgagtgcaggagaggggagcagaattcccagtgtagcggtgaaatgcgtagatattgggaggaataccagtggcgaaggcggctctctggactgtaactgacactgaggcgcgaaagcgtggggagcgaacaggattagataccctggtagtccacgccgtaaacgatgagtgctaggtgttgggggtatcgaccccccccagtgccgtagttaacacaataagcactccgcctggggagtacggtcgcaagactgaaactcaaaggaattgacgggggcccgcacaagcggtggagtatgtggtttaattcgacgcaacgcgaagaaccttaccagggcttgacatcctctgaaaagtatagagatatactccttgcccttcggggtaacagagagacaggtggtgcatggttgtcgtcagctcgtgtcgtgagatgttgggttaagtcccgcaacgagcgcaacccctaacattcgttgccagcgagtaatgtcgggaactcgaatgtgactgccgttgacaaaacggaggaaggtggggatgacgtcaaatcatcatgccccttatgtcctgggctacacacgtactacaatggccggtacagacggaagcgaagctgtgaagtgaagcaaatctgagaaagccggtcccagttcggattgtagtctgcaactcgactacatgaagtcggaatcgctagtaatcgcaggtcagcatactgcggtgaatacgttcccgggccttgtacacaccgcccgtcacaccacgaaagctgacaacacccgaagccggtgacttaaccgcaaggagagagccgtcgaaggtggggttggtgattggggtgaagtcgtaacaaggtagccgtatcggaaggtgcggctggatcacctcctttctaaggaga

SEQ ID NO: 3218 - DNA, 1264 bp, Desulfovermiculus halophilus
  ref <308>: DATABASE ACCESSION NUMBER: NCBI ACCESSION: NZ_JIAK01000073.1
  ref <309>: DATABASE ENTRY DATE: 2019-04-01
  ref <313>: RELEVANT RESIDUES IN SEQ ID NO: (1)..(1264)
taaaggtggcctctgcttcaagccatcgtctccggatgggtccgcgtcccattagcttgttggtggggtaatggcctaccaaggcaacgatgggtagctggtctgagaggatgatcagccacactgggactggaacacggcccagactcctacgggaggcagcagtggggaatattgggcaatgggcgcaagcctgacccagcgacgccgcgtgagggaagaaggccttcgggtcgtaaacctctgtcaggagggaagaagtgggtaccggttaacagctggtgcctttgacggtacctccaaaggaagcgccggccaactccgtgccagcagccgcggtaatacggagggcgcaagcgttattcggaatcactgggcgtaaagcgcgcgtaggcggcttcgtaagtcagatgtgaaagccctcggctcaaccgaggaattgcatttgaaactgcggagctagagttcgggagagggtggcggaattccaggtgtaggagtgaaatccgtagatatctggaggaacaccagaggcgaaggcggccacctggaccgaaactgacgctgaggtgcgaaagcgtgggtagcaaacaggattagataccctggtagtccacgccgtaaacgatggatgctagatgctgggtgcttatggcattcggtgtcgcagctaacgcgttaagcatcccgcctggggagtacggtcgcaaggctgaaactcaaaggaattgacgggggcccgcacaagcggtggagtatgtggtttaattcgatgcaacgcgaagaaccttacctgggcttgacatcccggggatcccctggagacaggggagtgcccttcggggaacccggagacaggtgctgcatggctgtcgtcagctcgtgccgtgaggtgttgggttaagtcccgcaacgagcgcaacccctgttcttagttgccagcacatgatggtgggcactctaaggagactgccgaggtgaactcggaggaaggtggggacgacgtcaagtcatcatggcccttacgcccagggctacacacgtactacaatggtgggcacaaagggacgcaagaccgtgaggtggagccaatcccagaaagcctaccccagttcggatcgcagtctgcaactcgactgcgtgaagtcggaatcgctagtaatcgtggatcagcatgccacggtgaatacgttcccgggccttgtacacaccgcccgtcacaccacgaaagctggctctacccgaagtcagtgagccaaccccc

SEQ ID NO: 3219 - DNA, 1242 bp, Desulfovibrio alaskensis
  ref <308>: DATABASE ACCESSION NUMBER: NCBI ACCESSION: NZ_AXWQ01000028.1
  ref <309>: DATABASE ENTRY DATE: 2019-04-01
  ref <313>: RELEVANT RESIDUES IN SEQ ID NO: (1)..(1242)
cctgccacactgggactggaacacggcccagactcctacgggaggcagcagtggggaatattgcgcaatgggcgaaagcctgacgcagcgacgccgcgtggaggatgaaggccttcgggtcgtaaactcctgtcaagagggaagaaccgtatgcggaataatacgccgcatgcctgacggtacctctagaggaagcaccggctaactccgtgccagcagccgcggtaatacggagggtgcaagcgttaatcggaatcactgggcgtaaagcgcgcgtaggcggcttggtaagtcaggtgtgaaagcccccggcccaaccggggaattgcacttgatactgctaggctagagttcaggagagggtggcggaattccaggtgtaggagtgaaatccgtagatatctggaggaacaccggtggcgaaggcggccacctggactgacactgacgctgaggtgcgaaagcgtgggtagcaaacaggattagataccctggtagtccacgccgtaaacgatggatactaggtgtcggggacttgatcctcggtgccgtagctaacgcgttaagtatcccgcctggggagtacggtcgcaaggctgaaactcaaagaaattgacgggggcccgcacaagcggtggagtatgtggtttaattcgatgcaacgcgaagaaccttacctaggcttgacatccggagaatccctccgaaaagagggagtgcccttcggggagctccgagacaggtgctgcatggctgtcgtcagctcgtgccgtgaggtgttgggttaagtcccgcaacgagcgcaacccctatcttcagttgccatcaggtaatgctgggcactctggagagactgccccggttaacggggaggaaggtggggacgacgtcaagtcatcatggcccttacgcctagggctacacacgtactacaatggcgcatacaaagggttgcgataccgcgaggtggagctaatcccaaaaagtgcgtctcagtccggattgcagtctgcaactcgactgcatgaagtcggaatcgctagtaatcccgtatcatcatgacggggtgaatgcgttcccgggccttgtacacaccgcccgtcacaccacgaaagttggttctgcccgacgccgatgagctaacccgcaagggaggcagtcgtctacggtagggccgatgattggggtgaagtcgtaacaaggtagccgtaggggaacctgcggctggatcacctcctttaa

SEQ ID NO: 3220 - DNA, 1553 bp, Desulfovibrio alcoholivorans
  ref <308>: DATABASE ACCESSION NUMBER: NCBI ACCESSION: NZ_JNJA01000005.1
  ref <309>: DATABASE ENTRY DATE: 2019-04-01
  ref <313>: RELEVANT RESIDUES IN SEQ ID NO: (1)..(1553)
ttaaactggagagtttgatcctggctcagattgaacgctggcggcgtgcttaacacatgcaagtcgtgcgagaaaggggacttcggtccctgagtagagcggcgcacgggtgagtaacgcgtggataatctccctcattgtttgggataacggcgggaaactgccgctaataccggatacgctccaatttcggttgggggaaaggcggcctctgcttgcaagctgtcgcaatgagatgagtccgcgtcccattagcttgttggtggggtaatggcctaccaaggcaacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcaggaaggaagaacctctcaaggctgaacaagtcttgggactgacggtacttccagaggaagcaccggctaactccgtgccagcagccgcggtaatacggagggtgcaagcgttaatcggaatcactgggcgtaaagcgcgcgtaggccgtcttttaagtcggacgtgaaagccctcggctcaaccggggaactgcgttcgatactgggagacttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgcggtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatccctcgaatcctcccgaaaaggaggagtgcccttcggggaacggggtgacaggtgctgcatggctgtcgtcagctcgtgccgtgaggtgttgggttaagtcccgcaacgagcgcaacccttgtccttagttgccagcgagtaatgtcgggcactctagggagaccgcctcggtcaacggggaggaaggtggggacgacgtcaagtcatcatggcccttacgcccagggctacacacgtactacaatggcgggtacaatgggctgcgagaccgcaaggtggagccaatcccaaaaaacccgtcccagtccggatcggggtctgcaactcgaccccgtgaagtcggaatcgctagtaatcggagatcagcatgctccggtgaatacgttcccgggccttgtacacaccgcccgtcacaccacgaaagtcggttctacccaaaaccgtcaggctaaccttcgggaggcagacgtctacggtagggctgatgattggggtgaagtcgtaacaaggtagccgtaggggaacctgcggctggatcacctcctttta

SEQ ID NO: 3221 - DNA, 1555 bp, Desulfovibrio alkalitolerans
  ref <308>: DATABASE ACCESSION NUMBER: NCBI ACCESSION: NZ_ATHI01000016.1
  ref <309>: DATABASE ENTRY DATE: 2019-04-01
  ref <313>: RELEVANT RESIDUES IN SEQ ID NO: (1)..(1555)
ttgaactggagagtttgatcctggctcagattgaacgctggcggcgtgcttaacacatgcaagtcgagcgagaaagtccgcttcggtggatgagtacagcggcgcacgggtgagtaacacgtggataatctaccgcgaggactgggataacaggtggaaacgcctgctaataccgggtacgcatcatatttatttatggtggaaagatggcctctgcttgcaagctatcgccttgtgatgagtccgcgtcccattagctagttggcggggtaatggcccaccaaggcaacgatgggtagctggtctgagaggatgatcagccacactggaactgaaacacggtccagactcctacgggaggcagcagtggggaatattgcgcaatgggcgaaagcctgacgcagcgacgccgcgtgagggaagaaggctttcgggtcgtaaacctctgtcaggagggaagaagtggcatacgggtaatatccgtatgttttgacggtacctccagaggaagcaccggctaactccgtgccagcagccgcggtaatacggagggtgcgagcgttaatcggaatcactgggcgtaaagcgcacgtaggcggcttggtaagtcacatgtgaaagccctcggctcaaccggggaactgcgtgtgatactgccttgcttgagtcctggagagggtggcggaattcccggtgtaggagtgaaatccgtagatatcgggaggaacaccagtggcgaaggcggccacctggacaggtactgacgctgaggtgcgaaagtgtggggagcaaacaggattagataccctggtagtccacactgtaaacgatggatgctaggtgtcggcgggttcaccgtcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctgggtttgacatccctcgaaccctgcggagacgcgggggtgcccttcggggagcggggagacaggtgctgcatggctgtcgtcagctcgtgccgtgaggtgttgggttaagtcccgcaacgagcgcaacccctattgtcagttgccagcaggtaaagctgggcactctggcgagactgcccgggtcaaccgggaggaaggtggggacgacgtcaagtcatcatggcccttacgtccagggctacacacgtactacaatggcggctacaaagggcagcgagaccgcgaggtggagccaatcccaaaaaagccgtcccagtccggattgcagtctgcaactcgactgcatgaagttggaatcgctagtaatcccggatcagcatgccggggtgaatacgttcccgggccttgtacacaccgcccgtcacaccacgaaagttggttctacccgaagccggcggactaaccgcaaggaggtagccgtctacggtagggccgatgattggggtgaagtcgtaacaaggtagccgtaggggaacctgcggctggatcacctccttta

SEQ ID NO: 3222 - DNA, 1557 bp, Desulfovibrio aminophilus
  ref <308>: DATABASE ACCESSION NUMBER: NCBI ACCESSION: NZ_KE383875.1
  ref <309>: DATABASE ENTRY DATE: 2019-04-01
  ref <313>: RELEVANT RESIDUES IN SEQ ID NO: (1)..(1557)
ttcaactggagagtttgatcctggctcagattgaacgctggcggcgtgcttaacacatgcaagtcgtgcgagaaaggttccttcggggactgagtagagcggcgcacgggtgagtaacgcgtgggtgacctacccaggagaccgggataacagtgggaaactgctgctaataccgggtacgcttcatatttcacgtatgggggaaaggcggcctctgcttgcaagctgccactcttggatgggcccgcgtctcattagcttgttggtagggtaacggcctaccaaggcgacgatgagtagctggtctgagaggatgatcagccacactgggactggaacacggcccagactcctacgggaggcagcagtggggaatattgcgcaatgggcgaaagcctgacgcagcgacgccgcgtgagggaagaaggccttcgggtcgtaaacctctgtcaggagggaagaaaccatgggagtcgaacaggctctcgtgctgacggtacctccggaggaagcaccggctaactccgtgccagcagccgcggtaatacggagggtgcaagcgttaatcggaatcactgggcgtaaagcgcacgtaggcggtgccgtaagtcggatgtgaaagccctcggctcaaccggggaactgcattcgatactgcggtgcttgagtgtcggagagggtggcggaattccaggtgtaggagtgaaatccgtagatatctggaggaacaccagtggcgaaggcggccacctggccgacaactgacgctgaggtgcgaaagcgtggggatcaaacaggattagataccctggtagtccacgctgtaaacgatggatgctaggtgtcgggggtttaccctcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatctctatgaaattagggagtgcccttcggggagcgcggagacaggtgctgcatggctgtcgtcagctcgtgccgtgaggtgttgggttaagtcccgcaacgagcgcaacccttgttgccagttgctaccaggtaatgctgggcactctggcgagactgcccgggtcaaccgggaggaaggtggggacgacgtcaagtcatcatggcccttacatccagggctacacacgtactacaatggcaggtacaaagggttgccaagccgcgaggccgcgctaatcccagaaagcctgtctcagtccggattgcagtctgcaactcgactgcatgaagctggaatcgctagtaatcccggatcagcatgccggggtgaatacgttcccgggccttgtacacaccgcccgtcacaccacgaaagctggttttacccgaagccggcggactaaccgcaagggggtagccgtctacggtaggaccggtgattggggtgaagtcgtaacaaggtagccgtaggggaacctgcggctggatcacctcctttaaa

SEQ ID NO: 3223 - DNA, 1126 bp, Desulfovibrio bastinii
  ref <308>: DATABASE ACCESSION NUMBER: NCBI ACCESSION: NZ_AUCX01000041.1
  ref <309>: DATABASE ENTRY DATE: 2019-04-01
  ref <313>: RELEVANT RESIDUES IN SEQ ID NO: (1)..(1126)
tagggtcgtaaacctctgtcaggagggaagaaccacataagatttaataaatcttttgtctgacggtacctccagaggaagcaccggctaactccgtgccagcagccgcggtaatacggagggtgcaagcgttaatcggaatcactgggcgtaaagcgcgcgtaggcggcgatgtaagtcaggtgtgaaagccctcggctcaaccggggaattgcacttgatactgcattgcttgagtatcggagaggatggcggaattccaggtgtaggagtgaaatccgtagatatctggaggaacaccagtggcgaaggcggccatctggacgattactgacgctgaggtgcgaaagcgtggggagcaaacaggattagataccctggtagtccacgctgtaaacgatggatactaggtgtcgggggctaaccccttcggtgccgcagttaacgcgttaagtatcccgcctggggagtacggtcgcaaggctgaaactcaaaggaattgacgggggcccgcacaagcggtggagtatgtggtttaattcgatgcaacgcgaagaaccttacctggacttgacatcctaggaatctctaagaaattagagagtgcccttcggggaatctagtgacaggtgctgcatggctgtcgtcagctcgtgccgtgaggtgttgggttaagtcccgcaacgagcgcaacccctatcatcagttgccatcacataatggtgggcactctggtgagactgcccgggttaaccgggaggaaggtggggacgacgtcaagtcatcatggcccttacgtccagggctacacacgtactacaatggcggatacaaagggtagcgaaaccgcgaggtgaagccaatcccaaaaagtccgtcccagtccggatcgcagtctgcaactcgactgtgtgaagttggaatcgctagtaatcccggatcagcatgccggggtgaatacgttcccgggccttgtacacaccgcccgtcacaccacgaaagctggttctacccgaaatcgacggactaaccttcgggaggtagtcgcctacggtagggctagtgattggggtgaagtcgtaacaaggtagccgtaggggaacctgcggctggatcacctccttta

SEQ ID NO: 3224 - DNA, 1553 bp, Desulfovibrio bizertensis
  ref <308>: DATABASE ACCESSION NUMBER: NCBI ACCESSION: NZ_FUYA01000027.1
  ref <309>: DATABASE ENTRY DATE: 2019-04-01
  ref <313>: RELEVANT RESIDUES IN SEQ ID NO: (1)..(1553)
atcaaactggagagtttgattctggctcagattgaacgctggtggcgtgcttaacacatgcaagtcgagcgagaaagcttcttcggaagtgagtagagcggcgcacgggtgagtaacgcgtggataatctacctagaagactgggataacagttggaaacgactgctaataccggatacgtccttgttttatttcaaggggaaagatggcctctgtttcatgctttcacttctagatgagtccgcgttccattagcttgatggtggggtaacggcctaccatggcgacgatggataactggtctaagaggatgatcagtcacactgggactggaacacggcccagactcctacgggaggcagcagtggggaatattgcgcaatgggggaaaccctgacgcagcgacgccacgtgagggatgaaggttttcggatcgtaaacctctgtcagaagggaagaaactaggttggtacaatatgccagtctactgacggtaccttcaaaggaagcaccggctaactccgtgccagcagccgcggtaatacggagggtgcaagcgttaatcggaattactgggcgtaaagcgtgcgtaggtggtttaccaagtcaggtgtgaaagcccacggctcaaccgtggaattgcacttgaaactggtaaactagagtcctggagagggtagtagaattcccggtgtaggagtgaaatccgtagatatcgggaggaataccagtggcgaaggcgactacctggacagtgactgacgctgaggtacgaaagtgtggggagcaaacaggattagataccctggtagtccacactgtaaacgatggatactagatgtcgggtggcaacattcggtgtcgtagctaacgcattaagtatcccgcctggggagtacggtcgcaaggctgaaactcaaagaaattgacgggggcccgcacaagcggtggagtatgtggtttaattcgatgcaacgcgaagaaccttacctgggtttgacatcctgcgaatctctcagagatgagagagtgcccttcggggaatgcagtgacaggtgctgcatggctgtcgtcagctcgtgccgtgaggtgttgggttaagtcccgcaacgagcgcaacccctattgttagttgctaacaggtgatgctgagcactctagcgagactgcccgggttaaccgggaggaaggtggggacgacgtcaagtcatcatggcccttacgcccagggctacacacgtactacaatggtgcagacaatgggcagctacgccgcgaggccaagcgaatcccaaaaactgcatcccagtccggattggagtctgcaactcgactccatgaagttggaatcgctagtaatcccggatcagcatgccggggtgaatacgttcccgggccttgtacacaccgcccgtcacaccacgaaagttggttttacccgaagtcgtcgagctaacccttgggaggcaggcgccgacggtagggccgataattggggtgaagtcgtaacaaggtagccgtaggggaacctgcggctggatcacctcctttta

SEQ ID NO: 3225 - DNA, 1551 bp, Desulfovibrio carbinolicus
  ref <308>: DATABASE ACCESSION NUMBER: NCBI ACCESSION: NZ_CP026538.1
  ref <309>: DATABASE ENTRY DATE: 2019-04-01
  ref <313>: RELEVANT RESIDUES IN SEQ ID NO: (1)..(1551)
taaactggagagtttgatcctggctcagattgaacgctggcggcgtgcttaacacatgcaagtcgtgcgagaaaggggacttcggtccctgagtagagcggcgcacgggtgagtaacgcgtggattatctacccagatattcgggataacggcgggaaactgccgctaataccggatacgctccaatttcggttgggggaaaggcggcctctgcttgcaagctgtcgtatctggatgagtccgcgtcccattagcttgttggcggggtaatggcccaccaaggctacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggagggaagaaccttccaggtctgaacaagccctggaactgacggtacctccaaaggaagcaccggctaactccgtgccagcagccgcggtaatacggagggtgcaagcgttaatcggaatcactgggcgtaaagcgcgcgtaggccgccttttaagtcggacgtgaaagccctcggctcaaccgaggaactgcgttcgaaactgggaggcttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgctgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaaaggaggagtgcccttcggggagcgcggtgacaggtgctgcatggctgtcgtcagctcgtgccgtgaggtgttgggttaagtcccgcaacgagcgcaacccttgtctttagttgccagcgagtaatgtcgggcactctagagagaccgcctcggtcaacggggaggaaggtggggacgacgtcaagtcatcatggcccttacgcccagggctacacacgtactacaatggtgggtacaatgggctgcgagaccgcaaggtggagccaatcccaaaaaacccatcccagtccggatcggggtctgcaactcgaccccgtgaagtcggaatcgctagtaatcggagatcagcatgctccggtgaatacgttcccgggccttgtacacaccgcccgtcacacccacgaaagttggttctacccgaaagctccgggctaaccgcaaggaggcaggagtctacggtagggccgatgattggggtgaagtcgtaacaaggtagccgtaggggaacctgcggctggatcacctccttt

SEQ ID NO: 3226 - DNA, 1329 bp, Desulfovibrio desulfuricans
  ref <308>: DATABASE ACCESSION NUMBER: NCBI ACCESSION: NZ_FQZR01000001.1
  ref <309>: DATABASE ENTRY DATE: 2019-04-01
  ref <313>: RELEVANT RESIDUES IN SEQ ID NO: (1)..(1329)
taaactggagagtttgattctggctcagattgaacgctggcggcgtgcctaacacatgcaagtcgaacgcgaaagtctcttcggagatgagtagagtggcgcacgggtgagtaacgcgtggataatctacctattggtacgggacaacagttggaaacgactgctaataccgtatacgctggaaacgggaaagggggcctcttcttgaaagctctcgccagtagatgagtccgcgtttcattagctagacggtggggtaacggcctaccgtggcaacgatgaatagcaggcctgagagggtggcctgccacactgggactggaacacggcccagactcctacgggaggcagcagtggggaatattgcgcaatggacgaaagtctgacgcagcgacgccgcgtggaggatgaaggttttcggatcgtaaactcctgtcaagagggaagaaacctgttaaaaataatacttttagcaattgacggtacctctagaggaagcaccggctaattcagtgccagcagccgcggtaatactgaaggtgcaagcgttaatcggaatcactgggcgtaaagcgctcgtaggtggctttgtaagtcaggtgtgaaagcccacggctcaaccgtggaattgcacttgatactgcatcgctagagtataggagagggaagtggaatttctggtgtaggagtgaaatccgtagagatcagaaggaacaccggtggcgaaggcgacttcctggactattactgacactgaggagcgaaagcgtggggagcaaacaggattagataccctggtagtccacgccgtaaacgatgggtactaagtgtcggaggcttgaccttcggtgctgtagttaacgcgttaagtaccccgcctggggagtacggtcgcaaggctgaaactcaaagaaattgacgggggcccgcacaagcggtggagtatgtggtttaattcgatgcaacgcgaagaaccttacccaggcttgacatcctgcgaatgcccaagaaattaggcagtgcccttcggggaatgcagtgacaggtgctgcatggctgtcgtcagctcgtgccgtgaggtgttgggttaagtcccgcaacgagcgcaacccctatccttagttgccaccaggtaatgctgagcactctagggagactgcccgggttaaccgggaggaaggtggggacgacgtcaagtcatcatggcccttacgcctggggctacacacgtactacaatggtgcatacaaagggttgcgataccgtgaggtggagctaatcccataaagtgcatcccagtccggataggagtctgcaactcgactcctt

SEQ ID NO: 3227 - DNA, 1554 bp, Desulfovibrio fairfieldensis
  ref <308>: DATABASE ACCESSION NUMBER: NCBI ACCESSION: NZ_CP014229.1
  ref <309>: DATABASE ENTRY DATE: 2019-04-01
  ref <313>: RELEVANT RESIDUES IN SEQ ID NO: (1)..(1554)
ttgaactggagagtttgattctggctcagattgaacgctggcggcgtgcttaacacatgcaagtcgaacgcgaaagagacttcggtctcgagtagagtggcgcacgggtgagtaacgcgtggataatctgccctcatgaccgggataacagttggaaacggctgctaataccggatacgctctgaatgaacttttaggggaaagacggcctctgcttgcaagctgtcgtatgaggatgagtccgcgtcccattagctggttggcggggtaacggcccaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaagtgcgtggtgctaatcagccgcgcattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacctagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaaccatttatggaggcagccgtctacggtagggccgatgattggggtgaagtcgtaacaaggtagccgtaggggaacctgcggctggatcacctcctttaa

SEQ ID NO: 3228 - DNA, 1021 bp, Desulfovibrio ferrireducens
  ref <308>: DATABASE ACCESSION NUMBER: NCBI ACCESSION: NZ_FNGA01000012.1
  ref <309>: DATABASE ENTRY DATE: 2019-04-01
  ref <313>: RELEVANT RESIDUES IN SEQ ID NO: (1)..(1021)
tttaactggagagtttgatcctggctcagattgaacgctggtggcgtgcttaacacatgcaagtcgagcgagaacggtttcttcggaaacttagtagagcggcgcacgggtgagtaacgcgtggatgatctacctttgagattgggataacagttggaaacggctgctaataccagatacgcttcatatttaactttatgagggaaagatggcctctgcttgcaagctatcgctcggagatgagtccgcgtttcattagctagttggtaaggtaatggcttaccaaggcgacgatgaatagctggtctgagaggatgaccagccacactgggactggaacacggcccagactcctacgggaggcagcagtggggaatattgcgcaatgggggaaaccctgacgcagcgacgccatgtgagggatgaaggctttcgggtcgtaaacctctgtcaggagggaagaacaacattaggtctaataaaccttttgtctgacggtacctccagaggaagcaccggctaactccgtgccagcagccgcggtaatacggagggtgcgagcgttaatcggaattactgggcgtaaagcgcgcgtaggcggcgatgtaagtcagatgtgaaagccctcggctcaaccggggaattgcacttgatactgcattgcttgagtatcggagaggatggcggaattccaggtgtaggagtgaaatccgtagatatctggaggaacaccagtggcgaaggcggccatctggacgataactgacgctgaggtgcgaaagcgtggggagcaaacaggattagataccctggtagtccacgctgtaaacgatggatgctagatgtcgggccttaaccggttcggtgtcgaagttaacgcgataagcatcccgcctggggagtacggtcgcaaggctgaaactcaaaggaattgacgggggcccgcacaagcggtggagtatgtggtttaattcgatgcaacgcgaagaaccttacctggacttgacatcctgagaatcct

SEQ ID NO: 3229 - DNA, 1552 bp, Desulfovibrio ferrophilus
  ref <308>: DATABASE ACCESSION NUMBER: NCBI ACCESSION: NZ_AP017378.1
  ref <309>: DATABASE ENTRY DATE: 2019-04-01
  ref <313>: RELEVANT RESIDUES IN SEQ ID NO: (1)..(1552)
taactggagagtttgatcctggctcagattgaacgctggcggcgtgcttaacacatgcaagtcgagcgagaaagtctccttcgggagatgagtagagcggcgcacgggtgagtaacgcgtggataatctacctttaggattgggataacagttggaaacggctgctaataccgaatacgctgcatatttatttatgtgggaaagatggcctcttcatgaaagctatcacctagagatgagtccgcgttccattagcttgttggtggggtaatggcctaccaaggcgacgatggatagctggtctgagaggatgatcagccacactggaactgaaacacggtccagactcctacgggaggcagcagtggggaatattgcgcaatgggggaaaccctgacgcagcgacgccgtgtgcgggacgaaggctttcgggtcgtaaaccgctgtcaggagggaagaaccgcatcagttcgaatagggctgttgcctgacggtacctccagaggaagcaccggctaactccgtgccagcagccgcggtaatacggagggtgcaagcgttaatcggaatcactgggcgtaaagcgtgcgtaggcggcttgccaagtcaggtgtgaaagccctcggctcaaccggggaattgcacttgaaactggtaggctagagtctcggagagggtggcggaattcccggtgtaggagtgaaatccgtagatatcgggaggaacaccagtggcgaaggcggccacctggacgatgactgacgctgaggtacgaaagcgtggggagcaaacaggattagataccctggtagtccacgccgtaaacgatggatgttaggtgtcgggtagcaatattcggtgccgtagttaacgcgttaaacatcccgcctggggagtacggtcgcaaggctgaaactcaaaggaattgacgggggcccgcacaagcggtggagtatgtggtttaattcgatgcaacgcgaagaaccttacctgggtttgacatcccgcgaatccgtccgagaagatggagtgcccttcggggaatgcggtgacaggtgctgcatggctgtcgtcagctcgtgccgtgaggtgttgggttaagtcccgcaacgagcgcaacccctatccttagttgccatcacataatggtgggcactctagggagactgcccgggtcaaccgggaggaaggtggggacgacgtcaagtcatcatggcccttacgcccagggctacacacgtactacaatggtggggacaacgggccgcgataccgcgaggtggagctaatcccaaaaaccccatcccagtccggattgcagtctgcaactcgactgcatgaagttggaatcgctagtaatcccggatcagcatgccggggtgaatacgttcccgggccttgtacacaccgcccgtcacaccacgaaagttggttctacccgaagtcgccaggctaacccttgggaggcaggcgcctacggtagggctgatgattggggtgaagtcgtaacaaggtagccgtaggggaacctgcggctggatcacctccttta

SEQ ID NO: 3230 - DNA, 1469 bp, Desulfovibrio frigidus
  ref <308>: DATABASE ACCESSION NUMBER: NCBI ACCESSION: NZ_JONL01000018.1
  ref <309>: DATABASE ENTRY DATE: 2019-04-01
  ref <313>: RELEVANT RESIDUES IN SEQ ID NO: (1)..(1469)
cttagtagagcggcgcacgggtgagtaacgcgtggatgatctaccttgaagattgggataacagctggaaacgactgctaataccaaatacgattcatatttaactttatgagtgaaagatggcctctgcttgcaagctatcgctttgagatgagtccgcgtttcattagctagttggtaaggtaatggcttaccaaggcgacgatgaatagctggtctgagaggatgaccagccacactgggactggaacacggcccagactcctacgggaggcagcagtggggaatattgcgcaatgggggaaaccctgacgcagcgacgccatgtgagggacgaaggctctagggtcgtaaacctctgtcagaagggaagaacctcattaagcttaatatgctttttgactgacggtaccttcagaggaagcaccggctaactccgtgccagcagccgcggtaatacggagggtgcgagcgttaatcggaattactgggcgtaaagcgcgcgtaggctgcgaagtaagtcagatgtgaaagccctcggctcaaccggggaattgcacttgatactgctttgcttgagtatcggagagggtggcggaattccaggtgtaggagtgaaatccgtagatatctggaggaacaccagtggcgaaggcggccacctggacgattactgacgctgaggtgcgaaagcgtggggagcaaacaggattagataccctggtagtccacgccgtaaacgatggatgctagatgtcgggccttaaccggttcggtgtcgaagttaacgcgataagcatcccgcctggggagtacggtcgcaaggctgaaactcaaaggaattgacgggggcccgcacaagcggtggagtatgtggtttaattcgatgcaacgcgaagaaccttacctggacttgacatcctgagaatcctttagaaataagggagtgcccttcggggaattcagtgacaggtgctgcatggctgtcgtcagctcgtgccgtgaggtgttgggttaagtcccgcaacgagcgcaacccctattgttagttgccatcacataatggtgggcactctaatgagactgcccgggtcaaccgggaggaaggtggggacgacgtcaagtcatcatggcccttacgtccagggctacacacgtactacaatggtggatacagagggtcgcgaagccgtgaggtgaagccaatcccagaaaatccatcccagtccggatcggagtctgcaactcgactccgtgaagttggaatcgctagtaatcccagatcagcatgctggggtgaatacgttcccgggccttgtacacaccgcccgtcacaccacgaaagctggttctacccaaaatcgacggactaaccttcgggaggtagtcgcctacggtagggctggtgattggggtgaagtcgtaacaaggtagccgtaggggaacctgcggctggatcacctccttta

SEQ ID NO: 3231 - DNA, 1551 bp, Desulfovibrio fructosivorans
  ref <308>: DATABASE ACCESSION NUMBER: NCBI ACCESSION: NZ_AECZ01000068.1
  ref <309>: DATABASE ENTRY DATE: 2019-04-01
  ref <313>: RELEVANT RESIDUES IN SEQ ID NO: (1)..(1551)
aaactggagagtttgatcctggctcagattgaacgctggcggcgtgcttaacacatgcaagtcgtgcgagaaagggggcttcggtccctgagtagagcggcgcacgggtgagtaacgcgtggatcatctgcccaaatgttcgggataacggcgggaaactgccgctaataccggatacgcttcaatttcggttgaaggaaaggcggcctctgcttgcaagctgtcgcatttggatgagtccgcgtcccattagcttgttggtggggtaacggcctaccaaggctacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggaaggaagaacctcccgggtccgaatagggctcgggactgacggtacttccaaaggaagcaccggctaactccgtgccagcagccgcggtaatacggagggtgcaagcgttaatcggaatcactgggcgtaaagcgcgcgtaggccgccttttaagtcggacgtgaaagccctcggctcaaccggggaattgcgttcgaaactgggaggcttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgccgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaacggaggagtgcccttcggggagcgcggtgacaggtgctgcatggctgtcgtcagctcgtgccgtgaggtgttgggttaagtcccgcaacgagcgcaacccttgtccttagttgccagcgagtaatgtcgggcactctagggagaccgcctcggtcaacggggaggaaggtggggacgacgtcaagtcatcatggcccttacgcccagggctacacacgtactacaatggcgggtacaatgggccgcgagaccgcaaggtggagccaatcccaaaaaacccgtcccagtccggatcggggtctgcaactcgaccccgtgaagtcggaatcgctagtaatcggagatcagcatgctccggtgaatacgttcccgggccttgtacacaccgcccgtcacaccacgaaagtcggttctacccaaaaccgtcaggctaaccttcgggaggcagacgtctacggtagggctgatgattggggtgaagtcgtaacaaggtagccgtaggggaacctgcggctggatcacctcctttta

SEQ ID NO: 3232 - DNA, 1548 bp, Desulfovibrio gigas
  ref <308>: DATABASE ACCESSION NUMBER: NCBI ACCESSION: NC_022444.1
  ref <309>: DATABASE ENTRY DATE: 2019-04-01
  ref <313>: RELEVANT RESIDUES IN SEQ ID NO: (1)..(1548)
taactggagagtttgattctggctcagattgaacgctggcggcgtgcttaacacatgcaagtcgagcgagaaagggtctttcgggacctgagtacagcggcgcacgggtgagtaacgcgtggatgatctacctcattgaccgggataacagtgggaaaccgctgctaatactggatacgcttcatggaaacatgagggaaaggcggcctctgatttaagctgtcacaatgagatgagtccgcgtctcattagcttgttggtagggtaatggcctaccaaggctacgatgagtagccggcctgagagggtggccggccacactggaactgaaacacggtccagactcctacgggaggcagcagtggggaatattgcgcaatgggcgaaagcctgacgcagcgacgccgcgtgagggaagaaggccttcgggtcgtaaacctctgtctggaggaaagaaacccataggttcgaatagggcttatggctgacggtacctccgaaggaagcaccggctaactccgtgccagcagccgcggtaatacggagggtgcaagcgttaatcggaatcactgggcgtaaagcgcacgtaggctgtcttgcaagtcaggtgtgaaagccctcggctcaaccggggaactgcacttgaaactgcatgacttgagtacaggagaggatggcagaattccgggtgtaggggtgaaatccgtagatatccggaggaataccagtggcgaaggcggccatctggactgtcactgacgctgaggtgcgaaagcgtggggagcaaacaggattagataccctggtagtccacgctgtaaacgatggacgctaggtgtcggggggtcgcccctcggcgccgaagctaacgcgttaagcgtcccgcctggggagtacggtcgcaaggctgaaactcaaagaaattgacgggggcccgcacaagcggtggagtatgtggtttaattcgatgcaacgcgaagaaccttacctaggcttgacatcccgggaaccctcccgaaaaggaggggtgctcttcggagagcccggagacaggtgctgcatggctgtcgtcagctcgtgccgtgaggtgttgggttaagtcccgcaacgagcgcaacccctgtccatagttgctaccaggtaaagctgggcactctatggagactgccttggcaacaaggaggaaggtggggatgacgtcaagtcatcatggcccttacgcctagggctacacacgtactacaatggcgagtacaaagggttgcgaaaccgcgaggttgagccaatcccaaaaagctcgtcccagtccggattgcagtctgcaactcgactgcatgaagtcggaatcgctagtaatcccggatcagcatgccggggtgaatacgttcccgggccttgtacacaccgcccgtcacaccacgaaagctggttctacccgaagccgccaagctaaccgcaaggaggcaggcgtctacggtagggccggtgattggggtgaagtcgtaacaaggtagccgtaggggaacctgcggctggatcacctccttt

SEQ ID NO: 3233 - DNA, 1557 bp, Desulfovibrio gracilis
  ref <308>: DATABASE ACCESSION NUMBER: NCBI ACCESSION: NZ_FUYC01000042.1
  ref <309>: DATABASE ENTRY DATE: 2019-04-01
  ref <313>: RELEVANT RESIDUES IN SEQ ID NO: (1)..(1557)
ttgaactggagagtttgatcctggctcagattgaacgctggcggcgtgcctaacacatgcaagtcgagcgagaaaggatccttcgggatctgagtagagcggcgcacgggtgagtaacgcgtaggtgatctaccctttggattgggataacagttggaaacggctgctaataccggatacactccatatttagctttatgggggaaaggtggcctctgcatgcaagctaccaccaaaggatgaacctgcgtctcattagcttgttggtggggtaatggcctaccaaggcgacgatgagtagctggtctgagaggatgatcagccacactgggactggaacacggcccagactcctacgggaggcagcagtggggaatattgcgcaatgggcgaaagcctgacgcagcgacgccgcgtgagggaagaaggctctcgggtcgtaaacctctgtcagaagggaagaaacccttgaggtcgaataggcctcttggctgacggtaccttcagaggaagcaccggctaattccgtgccagcagccgcggtaatacggaaggtgcaagcgttaatcggaattactgggcgtaaagcgcgcgtaggcggcgcggccagtcagatgtgaaagccctcggctcaaccggggaattgcatttgatactgccgtgcttgagtactggagaggcaggcggaattccaggtgtaggagtgaaatccgtagatatctggaggaacaccagtggcgaaggcggcctgctggacagatactgacgctgaggtgcgaaagcgtgggtagcaaacaggattagataccctggtagtccacgctgtaaacgatggatgctaggtgtcggggggtccaccctcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctaggcttgacatcctgggaaccctcctgaaacggaggggtgcccttcggggaatccagtgacaggtgctgcatggctgtcgtcagctcgtgccgtgaggtgttgggttaagtcccgcaacgagcgcaacccttgttactagttgccagcacataatggtgggcactctagtgagactgccggggttaacccggaggaaggtggggacgacgtcaagtcatcatggcccttacgcctagggctacacacgtactacaatggcgcgtacaatgggtcgctacgccgcgaggccaagccaatcccaaaaaacgcgtcccagtccggattgcagtctgcaactcgactgcatgaagttggaatcgctagtaatcccggatcagcatgccggggtgaatacgttcccgggccttgtacacaccgcccgtcacaccacgaaagctggttctacccgacatcggtgagctaaccttcgggaggcaaccgcctacggtaggactggtgattggggtgaagtcgtaacaaggtagccgtaggggaacctgcggctggatcacctccttta

SEQ ID NO: 3234 - DNA, 1561 bp, Desulfovibrio hydrothermalis
  ref <308>: DATABASE ACCESSION NUMBER: NCBI ACCESSION: NZ_AUDB01000023.1
  ref <309>: DATABASE ENTRY DATE: 2019-04-01
  ref <313>: RELEVANT RESIDUES IN SEQ ID NO: (1)..(1561)
ttttaactggagagtttgatcctggctcagattgaacgctggtggcgtgcttaacacatgcaagtcgtgcgagaacgtcttcttcggaagattagtagagcggcgcacgggtgagtaacgcgtggataatctgcctttgagattgggataacagttggaaacgactgctaataccgaatacgtttcatatttaactttatgagagaaagatggcctctgcttgcaagctatcgctcagagatgagtccgcgtttcattaggtagttggtgaggtaacggctcaccaagccgacgatgaatagctggtctgagaggatgaccagccacactgggactgaaacacggcccagactcctacgggaggcagcagtggggaatattgcgcaatgggggcaaccctgacgcagcgacgccatgtgagggatgaaggctttcgggtcgtaaacctctgtcaggagggaagaaactgttagggattaatactctctttcactgacggtacctccagaggaagcaccggctaactccgtgccagcagccgcggtaatacggagggtgcgagcgttaatcggaattactgggcgtaaagcgcgcgtaggcggccttataagtcaggtgtgaaagccctcggctcaaccggggaattgcacttgatactgtaaagcttgagtatcggagaggatggcggaattccaggtgtaggagtgaaatccgtagatatctggaggaacaccagtggcgaaggcggccatctggacgataactgacgctgaggtgcgaaagcgtggggagcaaacaggattagataccctggtagtccacgccgtaaacgatggatgctagatgtcgggggttaaccccttcggtgtcgaagttaacgcgataagcatcccgcctggggagtacggtcgcaaggctgaaactcaaaggaattgacgggggcccgcacaagcggtggagtatgtggtttaattcgatgcaacgcgaagaaccttacctggacttgacatcctgcgaatcctttagaaatagaggagtgcccttcggggaatgcagtgacaggtgctgcatggctgtcgtcagctcgtgccgtgaggtgttgggttaagtcccgcaacgagcgcaacccctatcactagttgccatcacataatggtgggcactctagtgagactgcccgggttaaccgggaggaaggtggggacgacgtcaagtcatcatggcccttacgtccagggctacacacgtactacaatggtggatacaaagggtcgcgaagccgcgaggtgaagccaatcccagaaagtccatcccagtccggatcgcagtctgcaactcgactgtgtgaagttggaatcgctagtaatcccggatcagcatgccggggtgaatacgttcccgggccttgtacacaccgcccgtcacaccacgaaagctggttctacccgaaatcgacagactaaccttcgggaggtagtcgcctacggtagggctggtgattggggtgaagtcgtaacaaggtagccgtaggggaacctgcggctggatcacctcctttata

SEQ ID NO: 3235 - DNA, 1267 bp, Desulfovibrio inopinatus
  ref <308>: DATABASE ACCESSION NUMBER: NCBI ACCESSION: NZ_AUBP01000068.1
  ref <309>: DATABASE ENTRY DATE: 2019-04-01
  ref <313>: RELEVANT RESIDUES IN SEQ ID NO: (1)..(1267)
ttgaactggagagtttgatcctggctcagattgaacgctggcgacgtgcttaacacatgcaagtcgtgcgagaaagtttccttcgggagatgagtagagcggcgcacgggtgagtaacgcgtggattatctgcccagaagttcgggataacagagggaaactcctgctaataccggatgtgacctacgggtgaaaggtggcctctatttataagctaccgcttttggatgagtccgcgtctcattagcttgatggtggggtaacggcctaccatggcgacgatgagtagctggtctgagaggatgatcagccacactgggactgaaacacggcccagactcctacgggaggcagcagtggggaatattgcgcaatgggggaaaccctgacgcagcgacgtcgtgtgagggaagaaggttctcggatcgtaaacctctgtcagaagggaagaaccacgtagggcccaatacgccctatgtctgacggtaccttcagaggaagcaccggctaactccgtgccagcagccgcggtaatacggagggtgcaagcgttaatcggaatcactgggcgtaaagcgcacgtaggcggctttgtaagtcagacgtgaaagcccacggctcaaccgtggaattgcgtttgatactgcatagcttgagtcctggagagggaagcggaattccgggtgtaggagtgaaatccgtagagatccggaggaacaccggtggcgaaggcggcttcctggacaggtactgacgctgaggtgcgaaagcgtggggagcaaacaggattagataccctggtagtccacgccgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctaggtttgacatctcccaaacgcccttgaaagagggaagtgcccttcggggaatgggatgacaggtgctgcatggctgtcgtcagctcgtgccgtgaggtgttgggttaagtcccgcaacgagcgcaacccttgtctttagttgccagcaggtaaggctgggcactctaaagagaccgccgcggtcaacgtggaggaaggtggggacgacgtcaagtcatcatggcccttacgcctagggctacacacgtactacaatggcgcatacaatgggtagcgaaaccg

SEQ ID NO: 3236 - DNA, 1097 bp, Desulfovibrio longus
  ref <308>: DATABASE ACCESSION NUMBER: NCBI ACCESSION: NZ_ATVA01000016.1
  ref <309>: DATABASE ENTRY DATE: 2019-04-01
  ref <313>: RELEVANT RESIDUES IN SEQ ID NO: (1)..(1097)
aaacccttgagggcgaataggcctcttggctgacggtaccttcagaggaagcaccggctaattccgtgccagcagccgcggtaatacggaaggtgcaagcgttaatcggaatcactgggcgtaaagcgcacgtaggcggcgcggtcagtcagatgtgaaagccctcggctcaaccgaggaattgcatttgatactgccgtgctcgagtactggagaggcaggcggaattccaggtgtaggagtgaaatccgtagatatctggaggaacaccagtggcgaaggcggcctgctggacagatactgacgctgaggtgcgaaagcgtggggagcaaacaggattagataccctggtagtccacgctgtaaacgatggatgctaggtgtcggggggttcaccttcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctaggcttgacatcctgagaaccctcccgaaaaggaggggtgcccttcggggaattcagtgacaggtgctgcatggctgtcgtcagctcgtgccgtgaggtgttgggttaagtcccgcaacgagcgcaacccttgtttctagttgccagcacataatggtgggcactctagtgagactgccggggttaacccggaggaaggtggggacgacgtcaagtcatcatggcccttacgcctagggctacacacgtactacaatggcacgtacaaagggttgctaagccgcgaggccacgccaatcccaaaaaacgtgtcccagtccggattgcagtctgcaactcgactgcatgaagttggaatcgctagtaatcccagatcagaatgctggggtgaatacgttcccgggccttgtacacaccgcccgtcacaccacgaaagctggttctacccgacatcggcaagctaaccttcgggaggcagccgcctacggtaggaccggtgattggggtgaagtcgtaacaaggtagccgtaggggaacctgcggctggatcacctcctttata

SEQ ID NO: 3237 - DNA, 1549 bp, Desulfovibrio magneticus
  ref <308>: DATABASE ACCESSION NUMBER: NCBI ACCESSION: NZ_JAGC01000003.1
  ref <309>: DATABASE ENTRY DATE: 2019-04-01
  ref <313>: RELEVANT RESIDUES IN SEQ ID NO: (1)..(1549)
aaactggagagtttgatcctggctcagattgaacgctggcggcgtgcttaacacatgcaagtcgtgcgagaaaggggacttcggtccctgagtagagcggcgcacgggtgagtaacgcgtggatgatctacccagatattcgggataacggcgggaaactgccgctaataccggatacgctccaatttcggttgggggaaaggcggcctctgcttgcaagctgtcgtatctggatgagtccgcgtcccattagcttgttggtggggtaatggcctaccaaggcgacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggagggaagaaccttccaggcctgaacaagtcctggaactgacggtacctccaaaggaagcaccggctaactccgtgccagcagccgcggtaatacggagggtgcaagcgttaatcggaatcactgggcgtaaagcgcgcgtaggcggccttttaagtcggacgtgaaagccctcggctcaaccggggaactgcgttcgaaactgggaggcttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgctgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaaaggaggagtgcccttcggggagcgcggtgacaggtgctgcatggctgtcgtcagctcgtgccgtgaggtgttgggttaagtcccgcaacgagcgcaacccttgtctttagttgccagcgagtaatgtcgggcactctagagagaccgcctcggtcaacggggaggaaggtggggacgacgtcaagtcatcatggcccttacgcccagggctacacacgtactacaatggtgggtacaatgggctgcgagaccgcaaggtggagccaatcccaaaaaacccatcccagtccggatcggggtctgcaactcgaccccgtgaagtcggaatcgctagtaatcggagatcagcatgctccggtgaatacgttcccgggccttgtacacaccgcccgtcacaccacgaaagtcggttctacccgaaagctccgggctaaccctcgggaggcaggagtctacggtagggctaatgattggggtgaagtcgtaacaaggtagccgtaggggaacctgcggctggatcacctccttt

SEQ ID NO: 3238 - DNA, 1556 bp, Desulfovibrio mexicanus
  ref <308>: DATABASE ACCESSION NUMBER: NCBI ACCESSION: NZ_FZOC01000002.1
  ref <309>: DATABASE ENTRY DATE: 2019-04-01
  ref <313>: RELEVANT RESIDUES IN SEQ ID NO: (1)..(1556)
tttaactggagagtttgatcctggctcagattgaacgctggaggcgtgcttaacacatgcaagtcgtgcgagaaagggacttcggtcctgagtagagcggcgcacgggtgagtaacgcgtgggtaatctcccctggtgatcgggataacagcgggaaactgctgctaataccggataatcttcatgtttaacttcatggggtaaaggtggcctctgcttgcaagctaccacatcaggatgagcccgcgtctcattagctagttggtagggtaatggcctaccaaggctacgatgagtagctggtctgagaggatgaccagccacactgggactggaacacggcccagactcctacgggaggcagcagtggggaatattgcgcaatgggcgaaagcctgacgcagcgacgcctcgtgagggatgaaggtcttcggatcgtaaacctctgtcaagagggaagaaacccttgagttcgaacagggctcttggctgacggtacctctaaaggaagcaccggctaactccgtgccagcagccgcggtaatacggagggtgcaagcgttaatcggaatcactgggcgtaaagcgctcgtaggcggtttggtcagtcagatgtgaaagccctcggcttaaccggggaactgcatttgatactgccagacttgagtgtcggagagggtggcggaattccgggtgtaggagtgaaatccgtagatatccggaggaacaccagtggcgaaggcggccacctggacgacaactgacgctgaggagcgaaagcgtggggagcaaacaggattagataccctggtagtccacgcggtaaacgatggatgctgggtgtcgggggtttaccttcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctaggcttgacatcttgagaaccctccggaaaaggaggggtgcccttcggggagctcaaagacaggtgctgcatggctgtcgtcagctcgtgccgtgaggtgttgggttaagtcccgcaacgagcgcaacccctattgctagttgccagcaagtaatgttgggcactctagtgagactgcccgggtcaaccgggaggaaggtggggatgacgtcaagtcatcatggcccttacgcctagggctacacacgtactacaatggcagatacaaagggcagctaagccgcgaggccatgccaatcccaaaaaatctgtctcagtccggattgcagtctgcaactcgactgcatgaagctggaatcgctagtaatcccggatcagcatgccggggtgaatacgttcccgggccttgtacacaccgcccgtcacaccacgaaagctggttttacccgaagccggcggactaaccgcaagggagtagtcgtcgacggtaggactggtgattggggtgaagtcgtaacaaggtagccgtaggggaacctgcggctggatcacctcctttata

SEQ ID NO: 3239 - DNA, 887 bp, Desulfovibrio oxyclinae
  ref <308>: DATABASE ACCESSION NUMBER: NCBI ACCESSION: NZ_AQXE01000012.1
  ref <309>: DATABASE ENTRY DATE: 2019-04-01
  ref <313>: RELEVANT RESIDUES IN SEQ ID NO: (1)..(887)
aactggagagtttgatcctggctcagattgaacgctggcggcgtgcttaacacatgcaagtcgtgcgagaaagtttccttcgggagatgagtagagcggcgcacgggtgagtaacgcgtgggtaatctacccgacagatcgggataacaggcggaaacgcctgctaataccggatacgcttcgtatttaactttacgggggaaaggtggcctctacatgtaagctaccactgtcggatgggcccgcgtctcattagcttgttggtggggtaatggcctaccaaggcaacgatgagtagctggtttgagaggatgatcagccacactgggactgaaacacggcccagactcctacgggaggcagcagtggggaatattgcgcaatgggggaaaccctgacgcagcgacgccgtgtgcgggaagaaggccttcgggtcgtaaaccgctgtcaggagggaagaaaccattagagtcgaataggctcttttgctgacggtacctccagaggaagcaccggctaactccgtgccagcagccgcggtaatacggagggtgcaagcgttaatcggaatcactgggcgtaaagcgtgcgtaggcggcgcagtaagtcaggggtgaaagccctcggctcaaccgaggaattgcctctgatactgctgtgcttgaggcttggagaggcaggcggaattccaggtgtaggagtgaaatccgtagatatcttgaggaacaccggtggcgaaggcggcctgctggacaagttctgacgctgaggtacgaaagcgtgggtagcaaacaggattagataccctggtagtccacgccgtaaacgatggatgctaggtgtcgggccgttgggttcggtgccgtagttaacgcgataagcatccc

SEQ ID NO: 3240 - DNA, 1554 bp, Desulfovibrio piger
  ref <308>: DATABASE ACCESSION NUMBER: NCBI ACCESSION: NZ_LT630450.1
  ref <309>: DATABASE ENTRY DATE: 2019-04-01
  ref <313>: RELEVANT RESIDUES IN SEQ ID NO: (1)..(1554)
ttgaactggagagtttgattctggctcagattgaacgctggcggcgtgcttaacacatgcaagtcgtacgcgaaagggacttcggtcccgagtaaagtggcgcacgggtgagtaacacgtggatgatctgcctctatgatggggataacagttggaaacgactgctaataccgaatacgctcatgatgaacgttgtgaggaaaggtggcctctgcttgcaagctatcgcatagagatgagtccgcgtcccattagctcgttggtggggtaacggcctaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggtcttcggatcgtaaacctctgtcagaagggaagaaactggggtgttctaatcagcatcccactgacggtaccttcaaaggaagcaccggctaactccgtgccagcagccgcggtaatacggagggtgcaagcgttaatcggaatcactgggcgtaaagcgcacgtaggctgttatgtaagtcaggggtgaaagcccacggctcaaccgtggaactgcccttgatactgcacgactcgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgccgtaaacgatggatgctagatgtcgggatgtatgtcccggtgtcgtagtcaacgcgttaagcatcccgcctggggagtacggtcgcaaggctgaaactcaaagaaattgacgggggcccgcacaagcggtggagtatgtggtttaattcgatgcaacgcgaagaaccttacctgggtttgacatctggggaatcctcccgaaaaggaggagtgcccttcggggagccccaagacaggtgctgcatggctgtcgtcagctcgtgtcgtgagatgttgggttaagtcccgcaacgagcgcaacccctatgcatagttgccagcaggtaaagctgggcactctatgcagactgcccgggttaaccgggaggaaggtggggacgacgtcaagtcatcatggcccttacacccagggctacacacgtactacaatggcacgcacaaagggcagcgataccgtgaggtggagccaatcccaaaaaacgtgtcccagtccggattgcagtctgcaactcgactgcatgaagtcggaatcgctagtaattcgaggtcagcatactcgggtgaatgcgttcccgggccttgtacacaccgcccgtcacaccacgaaagtcggttttacccgaagccggtgggccaacgagcaatcgaggcagccgtctacggtagggccgatgattggggtgaagtcgtaacaaggtagccgtaggggaacctgcggctggatcacctcctttaa

SEQ ID NO: 3241 - DNA, 1552 bp, Desulfovibrio putealis
  ref <308>: DATABASE ACCESSION NUMBER: NCBI ACCESSION: NZ_AUBQ01000027.1
  ref <309>: DATABASE ENTRY DATE: 2019-04-01
  ref <313>: RELEVANT RESIDUES IN SEQ ID NO: (1)..(1552)
aaactggagagtttgatcctggctcagattgaacgctggcgacgtgcttaacacatgcaagtcgtgcgagaaaggagacttcggtctctgagtagagcggcgcacgggtgagtaacgcgtggatgatctacccttgagttcgggataacggtgcgaaagcgccgctaataccgtataacaatccatttcatcgtgggttcaaagcaggcctcttcatgaaagcttgcgcttggggatgagtccgcgtcccattagcttgttggcggggtaacggcccaccaaggctacgatgggtagctggtctgagaggatgatcagccacactggaactgaaacacggtccagactcctacgggaggcagcagtggggaatattgcgcaatgggggaaaccctgacgcagcgacgtcgtgtgagggaagaaggccttcgggtcgtaaacctctgtcagaagggaagaacatccgggagtcgaacagcctcccggcctgacggtaccttcagaggaagcgccggctaactccgtgccagcagccgcggtaatacggagggcgcaagcgttaatcggaatcactgggcgtaaagcgtgcgtaggctgtttgataagtcagacgtgaaatccctcggctcaaccggggaactgcgtttgatactgttgaactagagtcctggagagggtggcggaattcctggtgtaggagtgaaatccgtagatatcaggaggaacaccggtggcgaaggcggccacctggacaggtactgacgctgaggtacgaaagcgtggggagcaaacaggattagataccctggtagtccacgcggtaaacgatggatgctaggtgtcggggagcgatcttcggcgccgcagctaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaattcctccgaaaagaggaagtgcccttcggggagcgcggtgacaggtgctgcatggctgtcgtcagctcgtgccgtgaggtgttgggttaagtcccgcaacgagcgcaacccttgtctttagttgccagcaggtaaggctgggcactctagagagaccgcctcggtcaacggggaggaaggtggggacgacgtcaagtcatcatggcccttacgcccagggctacacacgtactacaatggcggatacaaagggttgcgaagccgcgaggtggagccaatcccaaaaagtccgtctcagttcggattgcagtctgcaactcgactgcatgaagctggaatcgctagtaatcgcgcatcatcatggcgcggtgaatacgttcccgggccttgtacacaccgcccgtcacaccacgaaagttggttctacccgaagccgccgggctaaccgcaaggaggcaggcgtctacggtagtgctgatgattggggtgaagtcgtaacaaggtagccgtaggggaacctgcggctggatcacctccttta

SEQ ID NO: 3242 - DNA, 1558 bp, Desulfovibrio salexigens
  ref <308>: DATABASE ACCESSION NUMBER: NCBI ACCESSION: NC_012881.1
  ref <309>: DATABASE ENTRY DATE: 2019-04-01
  ref <313>: RELEVANT RESIDUES IN SEQ ID NO: (1)..(1558)
tttaactggagagtttgattctggctcagattgaacgctggtggcgtgcttaacacatgcaagtcgtgcgagaacagttccttcgggaacctagtagagcggcgcacgggtgagtaacgcgtggataatctacccagaagactgggataacagttggaaacgactgctaataccggatacgtttcatatttaactttatgagagaaaggtggcctctgtttcaagctatcacttttggatgagtccgcgtttcattagctagttggtaaggtaacggcttaccaaggcgacgatgaatagctggtctgagaggatgaccagccacactgggactggaacacggcccagactcctacgggaggcagcagtggggaatattgcgcaatgggggaaaccctgacgcagcgacgccatgtgagggacgaaggctttcgggtcgtaaacctctgtcaggagggaagaaactgtttgaggctaataccctctttcactgacggtacctccagaggaagcaccggctaactccgtgccagcagccgcggtaatacggagggtgcgagcgttaatcggaatcactgggcgtaaagcgcgcgtaggcggcgcgataagtcaggcgtgaaagccctcggctcaaccggggaattgcgcttgatactgtcgtgcttgagtctcggagagggtggcggaattccaggtgtaggagtgaaatccgtagatatctggaggaacaccagtggcgaaggcggccacctggacgagtactgacgctgaggtgcgaaagcgtggggagcaaacaggattagataccctggtagtccacgccgtaaacgatggatgctagatgtcgggccttaaccggttcggtgtcgaagttaacgcgataagcatcccgcctggggagtacggtcgcaaggctgaaactcaaagaaattgacgggggcccgcacaagcggtggagtatgtggtttaattcgatgcaacgcgaagaaccttacctggacttgacatcctgagaatcctctagaaatagaggagtgcccttcggggaattcagtgacaggtgctgcatggctgtcgtcagctcgtgccgtgaggtgttgggttaagtcccgcaacgagcgcaacccctattgctagttgccatcacataatggtgggcactctagtgagactgcccgggtcaaccgggaggaaggtggggacgacgtcaagtcatcatggcccttacgtccagggctacacacgtactacaatggtggatacaaagggttgccaagccgcgaggccgagccaatcccaaaaagtccatcccagtccggatcgcagtctgcaactcgactgtgtgaagttggaatcgctagtaatcccggatcagcatgccggggtgaatacgttcccgggccttgtacacaccgcccgtcacaccacgaaagctggttctacccgaaatcgacggactaaccctttgggaggtagtcgcctacggtagggctggtgattggggtgaagtcgtaacaaggtagccgtaggggaacctgcggctggatcacctccttta

SEQ ID NO: 3243 - DNA, 1554 bp, Desulfovibrio sp. 3 1 syn3
  ref <308>: DATABASE ACCESSION NUMBER: NCBI ACCESSION: NZ_ADDR02000003.1
  ref <309>: DATABASE ENTRY DATE: 2019-04-01
  ref <313>: RELEVANT RESIDUES IN SEQ ID NO: (1)..(1554)
ttgaactggagagtttgattctggctcagattgaacgctggcggcgtgcttaacacatgcaagtcgaacgcgaaagagacttcggtctcgagtagagtggcgcacgggtgagtaacgcgtggataatctgccctcataatcgggataacagttggaaacggctgctaataccggatacgctctgaatgaacttttaggggaaagacggcctctgcttgcaagctgtcgtatgaggatgagtccgcgtcccattagctagttggcggggtaacggcccaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaagtgcgtggtgctaatcagccgcgcattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacctagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaaccatttatggaggcagccgtctacggtagggccgatgattggggtgaagtcgtaacaaggtagccgtaggggaacctgcggctggatcacctcctttaa

SEQ ID NO: 3244 - DNA, 1554 bp, Desulfovibrio sp. 6 1 46AFAA
  ref <308>: DATABASE ACCESSION NUMBER: NCBI ACCESSION: NZ_JH114307.1
  ref <309>: DATABASE ENTRY DATE: 2019-04-01
  ref <313>: RELEVANT RESIDUES IN SEQ ID NO: (1)..(1554)
ttgaactggagagtttgattctggctcagattgaacgctggcggcgtgcttaacacatgcaagtcgaacgcgaaagaggcttcggtctcgagtagagtggcgcacgggtgagtaacgcgtggataatctgccctcataatcgggataacagttggaaacggctgctaataccggatacgctctgaatgaacttttaggggaaagacggcctctgcttgcaagctgtcgtatgaggatgagtccgcgtcccattagctggttggcggggtaacggcccaccaaggcaacgatgggtagccgatctgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcagaagggaagaaagtgcgtggtgctaatcagccgcgcattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcccttgatactgcatgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatctggggaaccctcccgaaaaggaggggtgcccttcggggagccccaagacaggtgctgcatggctgtcgtcagctcgtgtcgtgagatgttgggttaagtcccgcaacgagcgcaacccctatgcatagttgccagcaagtgaagttgggcactctatgcagactgcccgggttaaccgggaggaaggtggggacgacgtcaagtcatcatggcccttacacctagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaaccatttatggaggcagccgtctacggtagggccgatgattggggtgaagtcgtaacaaggtagccgtaggggaacctgcggctggatcacctcctttaa

SEQ ID NO: 3245 - DNA, 1551 bp, Desulfovibrio sp. A2
  ref <308>: DATABASE ACCESSION NUMBER: NCBI ACCESSION: NZ_AGFG01000025.1
  ref <309>: DATABASE ENTRY DATE: 2019-04-01
  ref <313>: RELEVANT RESIDUES IN SEQ ID NO: (1)..(1551)
ttcaactggagagtttgattctggctcagattgaacgctggcggcgtgcctaacacatgcaagtcgtgcgtgaaagggcttcggcctgagtaaagcggcgcacgggtgagtaacgcgtggatgatctgcccatgagttgggaataacggctggaaacggtcgctaataccgaatacgctccgatttcacagttcgggggaaaggtggcctctgcttgcaagctaccgctcatggatgagtccgcgtcccattagctagttggcggggtaatggcccaccaaggcgacgatgggtagccgacctgagagggtgatcggccacactgggactggaacacggcccagactcctacgggaggcagcagtggggaatattgcgcaatgggcgaaagcctgacgcagcgacgccgcgtgagggatgaaggccttcgggtcgtaaacctctgtcaggagggaagaaccgccatggtgctaatcagccatggtctgacggtacctccaaaggaagcaccggctaactccgtgccagcagccgcggtaatacggagggtgcaagcgttaatcggaatcactgggcgtaaagcgcacgtaggctgtttggtaagtcaggggtgaaatcccgcggctcaaccgcggaattgcccttgatactgctggacttgagttcgggagagggtggcggaattccaggtgtaggagtgaaatccgtagatatctggaggaacatcagtggcgaaggcggccacctggaccgatactgacgctgaggtgcgaaagcgtggggagcaaacaggattagataccctggtagtccacgctgtaaacgatggatgctaggtgtcggggccttgagcttcggtgccgcagctaacgcgttaagcatcccgcctggggagtacggtcgcaaggctgaaactcaaagaaattgacgggggcccgcacaagcggtggagtatgtggtttaattcgatgcaacgcgaagaaccttacccaggcttgacatccgggaaaccctcccgaaaaggaggggtgctcttcggagaatcccgagacaggtgctgcatggctgtcgtcagctcgtgccgtgaggtgttgggttaagtcccgcaacgagcgcaacccctatccttagttgccatcaggtgatgctgggcactctagggagaccgccccggttaacggggaggaaggtggggatgacgtcaagtcatcatggcccttacgcctggggctacacacgtactacaatggcgcacacaaagggcagcgataccgtgaggtggagccaatcccaaaaaatgcgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgataccggtgagccaaccgcaaggaggcagccgtctacggtagggccgatgattggggtgaagtcgtaacaaggtagccgtaggggaacctgcggctggatcacctccttta

SEQ ID NO: 3246 - DNA, 1553 bp, Desulfovibrio sp. AM18-2
  ref <308>: DATABASE ACCESSION NUMBER: NCBI ACCESSION: NZ_QRJJ01000018.1
  ref <309>: DATABASE ENTRY DATE: 2019-04-01
  ref <313>: RELEVANT RESIDUES IN SEQ ID NO: (1)..(1553)
gaactggagagtttgattctggctcagattgaacgctggcggcgtgcttaacacatgcaagtcgaacgcgaacggggcttcggccccaagtagagtggcgcacgggtgagtaacgcgtggacaatctgcccttatgactggaataacagttggaaacggctgctaataccggatacgctcaggaagaactttttgaggaaaggcggcctctgcttgcaagctgtcgcataaggatgagtccgcgtcccattagctagttggcggggtaacggcccaccaaggcaacgatgggtagccgatttgagaggatgatcggccacactgggactgaaacacggcccagactcctacgggaggcagcagtggggaatattgcgcaatgggcgaaagcctgacgcagcgacgccgcgtgagggatgaaggttttcggatcgtaaacctctgtcagaagggaagaaactgccgtgctctaatcatcatggcattgacggtaccttcaaaggaagcaccggctaactccgtgccagcagccgcggtaatacggagggtgcaagcgttaatcggaattactgggcgtaaagcgcacgtaggctgttgtgtaagtcaggggtgaaatcccacggctcaaccgtggaactgcctttgatactgcacgacttgaatccgggagagggtggcggaattccaggggtaggagtgaaatccgtagatatctggaggaacaccagtggcgaaggcggccacctggaccggtattgacgctgaggtgcgaaagcgtggggagcaaacaggattagataccctggtagtccacgccgtaaacgatggatgctagatgtcggggggttgccctcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctgggtttgacatccacggaaccctcttgaaagagaggggtgcccttcggggagccgtgagacaggtgctgcatggctgtcgtcagctcgtgtcgtgagatgttgggttaagtcccgcaacgagcgcaacccctatgcatagttgccagcaagtaacgttgggcactctatgcagactgcccgggttaaccgggaggaaggtggggacgacgtcaagtcatcatggcccttacatccagggctacacacgtactacaatggcgcgcacaaagggaagcgagaccgcgaggtggagccaatcccaaaaaacgcgtcccagtccggattgcagtctgcaactcgactgcatgaagtcggaatcgctagtaattcgagatcagcatgcgcgggtgaatgcgttcccgggccttgtacaccccgcccgtcacaccacgaaagtcggttttacccgaagccggtaagccaaccagcaatggaggcagccgtctacggtagggccgatgattggggtgaagtcgtaacaaggtagccgtaggggaacctgcggctggatcacctcctttatg

SEQ ID NO: 3247 - DNA, 1551 bp, Desulfovibrio sp. DV
  ref <308>: DATABASE ACCESSION NUMBER: NCBI ACCESSION: NZ_MLBG01000167.1
  ref <309>: DATABASE ENTRY DATE: 2019-04-01
  ref <313>: RELEVANT RESIDUES IN SEQ ID NO: (1)..(1551)
aaactggagagtttgatcctggctcagattgaacgctggcggcgtgcttaacacatgcaagtcgtgcgagaaaggggacttcggtccctgagtagagcggcgcacgggtgagtaacgcgtggataatctacccagatgttcgggataacggtgggaaactgccgctaataccggatacgatccaatttcggttgggtgaaaggcggcctctgtttacaagctgtcgcatctggatgagtccgcgtcccattagcttgttggtggggtaatggcctaccaaggctacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggagggaagaaccttccaggcctgaataagtcctggaactgacggtacctccaaaggaagcaccggctaactccgtgccagcagccgcggtaatacggagggtgcaagcgttaatcggaatcactgggcgtaaagcgcgcgtaggcggtcttttaagtcggacgtgaaagccctcggctcaaccggggaactgcgttcgaaactgggagacttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgctgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaaaggaggagtgcccttcggggagcgcggtgacaggtgctgcatggctgtcgtcagctcgtgccgtgaggtgttgggttaagtcccgcaacgagcgcaacccttgtctttagttgccagcgagtaatgtcgggcactctagagagaccgcctcggtcaacggggaggaaggtggggacgacgtcaagtcatcatggcccttacgcccagggctacacacgtactacaatggtgggtacaatgggctgcgagaccgcaaggtggagccaatcccaaaaaacccatcccagtccggatcggggtctgcaactcgaccccgtgaagtcggaatcgctagtaatcggagatcagcatgctccggtgaatacgttcccgggccttgtacacaccgcccgtcacaccacgaaagtcggttctacccgaaagctccgggctaaccctcgggaggcaggagtctacggtagggctaatgattggggtgaagtcgtaacaaggtagccgtaggggaacctgcggctggatcacctcctttta

SEQ ID NO: 3248 - DNA, 1551 bp, Desulfovibrio sp. FW1012B
  ref <308>: DATABASE ACCESSION NUMBER: NCBI ACCESSION: NZ_CM001368.1
  ref <309>: DATABASE ENTRY DATE: 2019-04-01
  ref <313>: RELEVANT RESIDUES IN SEQ ID NO: (1)..(1551)
ttaaactggagagtttgatcctggctcagattgaacgctggcggcgtgcttaacacatgcaagtcgtgcgagaaagggggcttcggtccctgagtagagcggcgcacgggtgagtaacgcgtggatcatctgcccaactgttcgggataacggcgggaaactgccgctaataccggatacgaatcaatttcggttgattgaaaggcggcctctgcttgcaagctgtcgctgttggatgagtccgcgtcccattagcttgttggtggggtaatggcctaccaaggctacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggaaggaagaaccccttagggccaaacaagccctgaggctgacggtacttccaaaggaagcaccggctaactccgtgccagcagccgcggtaatacggagggtgcaagcgttaatcggaatcactgggcgtaaagcgcgcgtaggcggtcttttaagtcggacgtgaaagccctcggctcaaccggggaattgcgttcgaaactgggagacttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgctgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaaaggaggagtgcccttcggggaacgcggtgacaggtgctgcatggctgtcgtcagctcgtgccgtgaggtgttgggttaagtcccgcaacgagcgcaacccttgtctttagttgccagcaagtaatgttgggcactctagagagaccgcctcggtcaacggggaggaaggtggggacgacgtcaagtcatcatggcccttacgcccagggctacacacgtactacaatggtgggtacaatgggctgcgagaccgcaaggtggagccaatcccaaaaaacccatcccagtccggatcggggtctgcaactcgaccccgtgaagtcggaatcgctagtaatcggagatcagcatgctccggtgaatacgttcccgggccttgtacacaccgcccgtcacaccacgaaagtcggttctacccaaaaccgccaggctaaccctcgggaggcaggcgtctacggtagggctgatgattggggtgaagtcgtaacaaggtagccgtaggggaacctgcggctggatcacctccttt

SEQ ID NO: 3249 - DNA, 1548 bp, Desulfovibrio sp. HK-II
  ref <308>: DATABASE ACCESSION NUMBER: NCBI ACCESSION: NZ_BDUJ01000001.1
  ref <309>: DATABASE ENTRY DATE: 2019-04-01
  ref <313>: RELEVANT RESIDUES IN SEQ ID NO: (1)..(1548)
aactggagagtttgattctggctcagattgaacgctggcggcgtgcctaacacatgcaagtcgtgcgtgaaagggcttcggcctgagtaaagcggcgcacgggtgagtaacgcgtggatgatctgcccatgagttgggaataacggctggaaacggtcgctaataccgaatacgctccgatttcacagttcgggggaaaggtggcctctgcttgcaagctaccgctcatggatgagtccgcgtcccattagctagttggcggggtaatggcccaccaaggcgacgatgggtagccgacctgagagggtgatcggccacactgggactggaacacggcccagactcctacgggaggcagcagtggggaatattgcgcaatgggcgaaagcctgacgcagcgacgccgcgtgagggatgaaggccttcgggtcgtaaacctctgtcaggagggaagaaccgccatggtgctaatcagccatggtctgacggtacctccaaaggaagcaccggctaactccgtgccagcagccgcggtaatacggagggtgcaagcgttaatcggaatcactgggcgtaaagcgcacgtaggctgtctggtaagtcaggggtgaaatcccgcggctcaaccgcggaattgcccttgatactgctggacttgagttcgggagagggtggcggaattccaggtgtaggagtgaaatccgtagatatctggaggaacatcagtggcgaaggcggccacctggaccgatactgacgctgaggtgcgaaagcgtggggagcaaacaggattagataccctggtagtccacgctgtaaacgatggatgctaggtgtcggggccttgagcttcggtgccgcagctaacgcgttaagcatcccgcctggggagtacggtcgcaaggctgaaactcaaagaaattgacgggggcccgcacaagcggtggagtatgtggtttaattcgatgcaacgcgaagaaccttacccaggcttgacatccgggaaaccctcccgaaaaggaggggtgctcttcggagaatcccgagacaggtgctgcatggctgtcgtcagctcgtgccgtgaggtgttgggttaagtcccgcaacgagcgcaacccctatccttagttgccaccaggtgatgctgggcactctagggagaccgccccggttaacggggaggaaggtggggatgacgtcaagtcatcatggcccttacgcctggggctacacacgtactacaatggcgcacacaaagggcagcgataccgcgaggtggagccaatcccaaaaaatgcgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgataccggtgagccaaccgcaaggaggcagccgtctacggtagggccgatgattggggtgaagtcgtaacaaggtagccgtaggggaacctgcggctggatcacctccttta

SEQ ID NO: 3250 - DNA, 1558 bp, Desulfovibrio sp. K3S
  ref <308>: DATABASE ACCESSION NUMBER: NCBI ACCESSION: NZ_FWZU01000011.1
  ref <309>: DATABASE ENTRY DATE: 2019-04-01
  ref <313>: RELEVANT RESIDUES IN SEQ ID NO: (1)..(1558)
tttaactggagagtttgatcctggctcagattgaacgctggtggcgtgcttaacacatgcaagtcgtgcgagaaagcgtccttcgggacgttagtagagcggcgcacgggtgagtaacgcgtggataatctacccctgagattgggataacagttggaaacggctgctaataccaaatacgcttcatatttaactttatgagggaaaggtggcctctgcttgcaagctatcactcaaggatgagtccgcgtttcattagctagttggtagggtaatggcctaccaaggcgacgatgaatagctggtctgagaggatgaccagccacactgggactggaacacggcccagactcctacgggaggcagcagtggggaatattgcgcaatgggggaaaccctgacgcagcgacgccatgtgagggacgaaggctctagggtcgtaaacctctgtcagaagggaagaacctcataaagcttaatacgctttttgactgacggtaccttcagaggaagcaccggctaactccgtgccagcagccgcggtaatacggagggtgcgagcgttaatcggaattactgggcgtaaagcgcgcgtaggcggcgatgtaagtcagatgtgaaagccctcggctcaaccggggaattgcacttgatactgcattgcttgagtatcggagaggatggcggaattccaggtgtaggagtgaaatccgtagatatctggaggaacaccagtggcgaaggcggccatctggacgataactgacgctgaggtgcgaaagcgtggggagcaaacaggattagataccctggtagtccacgctgtaaacgatggatgctagatgtcgggccttaaccggttcggtgtcgaagttaacgcgataagcatcccgcctggggagtacggtcgcaaggctgaaactcaaaggaattgacgggggcccgcacaagcggtggagtatgtggtttaattcgatgcaacgcgaagaaccttacctggacttgacatcctgagaatcctctagaaatagaggagtgcccttcggggaattcagtgacaggtgctgcatggctgtcgtcagctcgtgccgtgaggtgttgggttaagtcccgcaacgagcgcaacccctattgctagttgccatcacataatggtgggcactctagtgagactgcccgggtcaaccgggaggaaggtggggacgacgtcaagtcatcatggcccttacgtccagggctacacacgtactacaatggtggatacagagggtcgcgaagccgcgaggtagagccaatcccagaaaatccatcccagtccggatcgcagtctgcaactcgactgtgtgaagttggaatcgctagtaatcccggatcagcatgccggggtgaatacgttcccgggccttgtacacaccgcccgtcacaccacgaaagctggttctacccaaaatcgacggactaaccttcgggaggtagtcgcctacggtagggctggtaattggggtgaagtcgtaacaaggtagccgtaggggaacctgcggctggatcacctccttta

SEQ ID NO: 3251 - DNA, 1551 bp, Desulfovibrio sp. L21-Syr-AB
  ref <308>: DATABASE ACCESSION NUMBER: NCBI ACCESSION: NZ_JOMJ01000003.1
  ref <309>: DATABASE ENTRY DATE: 2019-04-01
  ref <313>: RELEVANT RESIDUES IN SEQ ID NO: (1)..(1551)
ttaactggagagtttgatcctggctcagattgaacgctggcggcgtgcctaacacatgcaagtcgagcgagaaagttctcttcggagaatgagtacagcggcgcacgggtgagtaacgcgtggacaacctgcccggatgactgggataacaggcggaaacgcctgctaataccggatatgtttcatattttatatggagcaaagatggcctctgcttgcaagctatcgcatccggatgggtccgcgtcccattagctagttggtagggtaatggcctaccaaggcgacgatgggtagctggtttgagaggatgatcagccacactgggactggaacacggcccagactcctacgggaggcagcagtggggaatattgcgcaatgggcgaaagcctgacgcagcgacgccgcgtgagggaagaaggtcttcggatcgtaaacctctgtcagaagggaagaagtgatgtacggttaatatccgtgcattttgacggtaccttcagaggaagcaccggctaactccgtgccagcagccgcggtaatacggagggtgcaagcgttaatcggaatcactgggcgtaaagcgcgcgtaggcggcctggcaagtcaaatgtgaaagccctcggctcaaccggggaactgcattcgaaactgtcaggcttgagtctcggagagggtggcggaattcccggtgtaggagtgaaatccgtagatatcgggaggaacaccagtggcgaaggcggccacctggacgagaactgacgctgaggtgcgaaagcgtgggtagcaaacaggattagataccctggtagtccacgccgtaaacgatggatgctaggtgtcggggggttgaccttcggtgccgcagtaaacgcattaagcatcccgcctggggagtacggtcgcaaggctgaaactcaaaggaattgacggggcccgcacaagcggtggagtatgtggtttaattcgatgcaacgcgaagaaccttacctgggtttgacatccttggaatccccccgagaagggggagtgcccttcggggagccaagtgacaggtgctgcatggctgtcgtcagctcgtgccgtgaggtgttgggttaagtcccgcaacgagcgcaacccttatcgttagttgccagcacatgatggtgggcactctagcgagactgcccgggtcaaccgggaggaaggtggggatgacgtcaagtcatcatggcccttacgcccagggctacacacgtactacaatggggggtacaaagggctgctaaaccgtgaggtcacgctaatcccagaaagcccctcccagtccgaatcgcagtctgcaactcgactgcgtgaagttggaatcgctagtaatcccggatcagcatgccggggtgaatacgttcccgggccttgtacacaccgcccgtcacaccacgaaagtcggttctacccgaagccggtgcgccaaccttgtgaggcagccgtcgacggtagggccggcaattggggtgaagtcgtaacaaggtagccgtaggggaacctgcggctggatcacctccttta

SEQ ID NO: 3252 - DNA, 1552 bp, Desulfovibrio sp. OH1186 COT-070
  ref <308>: DATABASE ACCESSION NUMBER: NCBI ACCESSION: NZ_RQYH01000054.1
  ref <309>: DATABASE ENTRY DATE: 2019-04-01
  ref <313>: RELEVANT RESIDUES IN SEQ ID NO: (1)..(1552)
ttgaactggagagtttgattctggctcagattgaacgctggcggcgtgcttaacacatgcaagtcgaacgtgaaaggggcttcggccccgagtaaagtggcgcacgggtgagtaacgcgtggacaatctgcccttatgagtgggataacagttggaaacggctgctaataccgcatacgctcaggaatgactttttgaggaaaggcggcctctgcttgcaagctgtcgcataaggatgagtccgcgtcccattagcttgttggtggggtaacggcctaccaaggcaacgatgggtagccgatttgagaggatgatcggccacactggaactgaaacacggtccagactcctacgggaggcagcagtggggaatattgcgcaatgggcgaaagcctgacgcagcgacgccgcgtgagggatgaaggttttcggatcgtaaacctctgtcggaagggaagaaggtgcactctgctaatcaggggtgtattgacggtaccttcaaaggaagcaccggctaactccgtgccagcagccgcggtaatacggagggtgcgagcgttaatcggaattactgggcgtaaagcgcacgtaggctgtcatgtaagtcaggggtgaaatcccacggctcaaccgtggaactgcctttgatactgcgtgacttgaatccgggagagggtggcggaattccaggtgtaggagtgaaatccgtagatatctggaggaacatcagtggcgaaggcggccacctggaccggtattgacgctgaggtgcgaaagcgtggggagcaaacaggattagataccctggtagtccacgctgtaaacgatggatgctagatgtcggggagtattcttcggtgtcgtagttaacgcgttaagcatcccgcctggggagtacggtcgcaaggctgaaactcaaagaaattgacgggggcccgcacaagcggtggagtatgtggtttaattcgatgcaacgcgaagaaccttacctgggtttgacatccacggaaccctccggaaatggaggggtgcccttcggggagccgtgagacaggtgctgcatggctgtcgtcagctcgtgtcgtgagatgttgggttaagtcccgcaacgagcgcaacccctatgcatagttgccatcaagtgaagttgggcactctatgcagactgcccgggttaaccgggaggaaggtggggacgacgtcaagtcatcatggcccttacacccagggctacacacgtactacaatggcgcgcacaaaggggagcgagaccgcgaggtggagccaatcccaaaaaacgcgtcccagtccggattgcagtctgcaactcgactgcatgaagtcggaatcgctagtaattcgagatcagcatgctcgggtgaatgcgttcccgggccttgtacacaccgcccgtcacaccacgaaagtcggttttacccgaagccggtgagccaaccagcaatggaggcagccgtctacggtagggctgatgattggggtgaagtcgtaacaaggtagccgtaggggaacctgcggctggatcacctccttt

SEQ ID NO: 3253 - DNA, 1552 bp, Desulfovibrio sp. OH1209 COT-279; identical to SEQ ID NO: 3252
  ref <308>: DATABASE ACCESSION NUMBER: NCBI ACCESSION: NZ_RQYK01000054.1
  ref <309>: DATABASE ENTRY DATE: 2019-04-01
  ref <313>: RELEVANT RESIDUES IN SEQ ID NO: (1)..(1552)

SEQ ID NO: 3254 - DNA, 1551 bp, Desulfovibrio sp. TomC
  ref <308>: DATABASE ACCESSION NUMBER: NCBI ACCESSION: NZ_JSEH01000052.1
  ref <309>: DATABASE ENTRY DATE: 2019-04-01
  ref <313>: RELEVANT RESIDUES IN SEQ ID NO: (1)..(1551)
aaactggagagtttgatcctggctcagattgaacgctggcggcgtgcttaacacatgcaagtcgtgcgagaaaggggacttcggtccctgagtagagcggcgcacgggtgagtaacgcgtggataatctacccagatgttcgggataacggcgggaaactgccgctaataccggatacgatccaatttcggttgggtgaaaggcggcctctgtttacaagctgtcgcatctggatgagtccgcgtcccattagcttgttggtggggtaatggcctaccaaggcgacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggagggaagaaccttccaggcctgaataagtcctggaactgacggtacctccaaaggaagcaccggctaactccgtgccagcagccgcggtaatacggagggtgcaagcgttaatcggaatcactgggcgtaaagcgcgcgtaggcggtcttttaagtcggacgtgaaagccctcggctcaaccggggaactgcgttcgaaactgggagacttgagtcctggagagggtggcggaattccgggtgtaggagtgaaatccgtagatatccggaggaacaccggtggcgaaggcggccacctggacaggtactgacgctgaggcgcgaaagcgtggggagcaaacaggattagataccctggtagtccacgctgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaaaggaggagtgcccttcggggagcgcggtgacaggtgctgcatggctgtcgtcagctcgtgccgtgaggtgttgggttaagtcccgcaacgagcgcaacccttgtctttagttgccagcgagtaatgtcgggcactctagagagaccgcctcggtcaacggggaggaaggtggggacgacgtcaagtcatcatggcccttacgcccagggctacacacgtactacaatggtgggtacaatgggctgcgagaccgcaaggtggagccaatcccaaaaaacccatcccagtccggatcggggtctgcaactcgaccccgtgaagtcggaatcgctagtaatcggagatcagcatgctccggtgaatacgttcccgggccttgtacacaccgcccgtcacaccacgaaagtcggttctacccgaaagctccgggctaaccctcgggaggcaggagtctacggtagggctaatgattggggtgaagtcgtaacaaggtagccgtaggggaacctgcggctggatcacctcctttta

SEQ ID NO: 3255 - DNA, 1555 bp, Desulfovibrio sp. U5L
  ref <308>: DATABASE ACCESSION NUMBER: NCBI ACCESSION: NZ_JH600068.1
  ref <309>: DATABASE ENTRY DATE: 2019-04-01
  ref <313>: RELEVANT RESIDUES IN SEQ ID NO: (1)..(1555)
ttaaactggagagtttgatcctggctcagattgaacgctggcggcgtgcttaacacatgcaagtcgtgcgagaaaggggacttcggtccctgagtagagcggcgcacgggtgagtaacgcgtggatcatctgcccaactgttcgggataacggcgggaaactgccgctaataccggatacgaatcaatttcggttgattgaaaggcggcctctgcttgcaagctgtcgctgttggatgagtccgcgtcccattagcttgttggtggggtaatggcctaccaaggctacgatgggtagctggtctgagaggatgatcagccacactggaactgaaacacggtccagactcctacgggaggcagcagtggggaatattgcgcaatgggggaaaccctgacgcagcgacgccgtgtgagggaagaaggctttcgggtcgtaaacctctgtcgggaaggaagaaccccttggggccaaataagccccgaggctgacggtacttccaaaggaagcaccggctaactccgtgccagcagccgcggtaatacggagggtgcaaggcgttaatcggaatcactgggcgtaaagcgcgcgtaggcggtcttttaagtcggacgtgaaagccctcggctcaaccggggaattgcgttcgaaactgggagacttgagtcctggagagggtggcggaattccgggtgtaggggtgaaatccgtagatatccggaggaacaccggtggcgaaggcggccacctggacaggtactgacgctgaggcgcgaaagcgtggggagcaaacaggattagataccctggtagtccacgctgtaaacgatggatgctaggtgtcggggagcgatcttcggtgccgcagttaacgcattaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaatcctcccgaaaaggaggcgtgcccttcggggagcgcggtgacaggtgctgcatggctgtcgtcagctcgtgccgtgaggtgttgggttaagtcccgcaacgagcgcaacccttgtctttagttgccagcaagtaatgttgggcactctagagagaccgcctcggtcaacggggaggaaggtggggacgacgtcaagtcatcatggcccttacgcccagggctacacacgtactacaatggtgggtacaatgggctgcgagaccgcaaggtggagccaatcccaaaaaacccatcccagtccggatcggggtctgcaactcgaccccgtgaagtcggaatcgctagtaatcggagatcagcatgctccggtgaatacgttcccgggccttgtacacaccgcccgtcacaccacgaaagtcggttctacccaaaaccgccaggctaaccctcgggaggcaggcgtctacggtagggctgatgattggggtgaagtcgtaacaaggtagccgtaggggaacctgcggctggatcacctccttttta

SEQ ID NO: 3256 - DNA, 1427 bp, Desulfovibrio sp. X2
  ref <308>: DATABASE ACCESSION NUMBER: NCBI ACCESSION: NZ_ATHV01000047.1
  ref <309>: DATABASE ENTRY DATE: 2019-04-01
  ref <313>: RELEVANT RESIDUES IN SEQ ID NO: (1)..(1427)
gatctgcgaggactgggataacaggtggaaacgcctgctaataccgggtacgcatcatattttatatggtggaaagatggcctctgcttgcaagctatcgccttgtgatgagtccgcgtcccattagctagttggcggggtaatggcccaccaaggcaacgatgggtagctggtctgagaggatgatcagccacactggaactgaaacacggtccagactcctacgggaggcagcagtggggaatattgcgcaatgggcgaaagcctgacgcagcgacgccgcgtgagggaagaaggccttcgggtcgtaaacctctgtcaggagggaagaagtggagtatggctaatatccatgctctttgacggtacctccggaggaagcaccggctaactccgtgccagcagccgcggtaatacggagggtgcgagcgttaatcggaatcactgggcgtaaagcgcgcgtaggcggctttgtaagtcaagtgtgaaagccctcggctcaaccggggaactgcgcttgatactgcatggcttgagtcctggagagggtggcggaattcccggtgtaggagtgaaatccgtagatatcgggaggaacaccagtggcgaaggcggccacctggacaggtactgacgctgaggtgcgaaagtgtggggagcaaacaggattagataccctggtagtccacacggtaaacgatggatgctaggtgtcggggagttcatcttcggtgccgcagttaacgcgttaagcatcccgcctggggagtacggtcgcaaggctgaaactcaaaggaattgacgggggcccgcacaagcggtggagtatgtggtttaattcgatgcaacgcgaagaaccttacctgggtttgacatcccgcgaagccttcagagatgagggtgtgcccttcggggagcgcggagacaggtgctgcatggctgtcgtcagctcgtgccgtgaggtgttgggttaagtcccgcaacgagcgcaacccttgttgtcagttgccagcaggtaaagctgggcactctggcgagactgcccgggtcaaccgggaggaaggtggggacgacgtcaagtcatcatggcccttacgtccagggctacacacgtactacaatggtgggtacaaagggcagcgaaaccgcgaggtgaagccaatcccaaaaaacccatcccagtccggattgcagtctgcaactcgactgcatgaagttggaatcgctagtaatcccagatcagcatgctggggtgaatacgttcccgggccttgtacacaccgcccgtcacaccacgaaagttggttctacccgaagccggcggactaacccgcaaggggagtagtcgtctacggtagggccgataattggggtgaagtcgtaacaaggtagccgtaggggaacctgcggctggatcacctccttta

SEQ ID NO: 3257 - DNA, 1552 bp, Desulfovibrio termitidis
  ref <308>: DATABASE ACCESSION NUMBER: NCBI ACCESSION: NZ_KI632512.1
  ref <309>: DATABASE ENTRY DATE: 2019-04-01
  ref <313>: RELEVANT RESIDUES IN SEQ ID NO: (1)..(1552)
ttttaactggagagtttgattctggctcagattgaacgctggcggcgtgcctaacacatgcaagtcgtgcgtgaaagggcttcggcctgagtaaagcggcgcacgggtgagtaacgcgtggatgatctgcccatgagttgggaataacggctggaaacggtcgctaataccgaatacgctccgatttcatagttcgggggaaaggtggcctctgcttgcaagctaccgctcatggatgagtccgcgtcccattagcttgttggcggggtaatggcccaccaaggcgacgatgggtagccgacctgagagggtgatcggccacactgggactggaacacggcccagactcctacgggaggcagcagtggggaatattgcgcaatgggcgaaagcctgacgcagcgacgccgcgtgagggatgaaggccttcgggtcgtaaacctctgtcaggagggaagaaccgccatggtgctaatcagccatggtctgacggtacctccaaaggaagcaccggctaactccgtgccagcagccgcggtaatacggagggtgcaagcgttaatcggaatcactgggcgtaaagtgcacgtaggctgtttggtaagtcaggggtgaaatcccgcggctcaaccgcggaattgcccttgatactgctggacttgagttcgggagagggtggcggaattccaggtgtaggagtgaaatccgtagatatctggaggaacatcagtggcgaaggcggccacctggaccgatactgacgctgaggtgcgaaagcgtggggagcaaacaggattagataccctggtagtccacgctgtaaacgatggatgctaggtgtcggggccttgtgcttcggtgccgcagctaacgcgttaagcatcccgcctggggagtacggtcgcaaggctgaaactcaaagaaattgacgggggcccgcacaagcggtggagtatgtggtttaattcgatgcaacgcgaagaaccttacccaggcttgacatccgggaaaccctcccgaaaaggaggggtgctcttcggagaatcccgagacaggtgctgcatggctgtcgtcagctcgtgccgtgaggtgttgggttaagtcccgcaacgagcgcaacccctgttcatagttgctaccaggtaatgctgggcactctatggagaccgccccggttaacggggaggaaggtggggatgacgtcaagtcatcatggcccttacgcctggggctacacacgtactacaatggcgcacacaaagggcagcgataccgtgaggtggagccaatcccaaaaaatgcgtcccagtccggattgcagtctgcaactcgactgcatgaagttggaatcgctagtaattcgagatcagcatgctcgggtgaatgcgttcccgggccttgtacacaccgcccgtcacaccacgaaagtcggttttacccgataccggtgagccaaccgcaaggaggcagccgtctacggtagggccgatgattggggtgaagtcgtaacaaggtagccgtaggggaacctgcggctggatcacctccttta

SEQ ID NO: 3258 - DNA, 1541 bp, Desulfovibrio vulgaris
  ref <308>: DATABASE ACCESSION NUMBER: NCBI ACCESSION: NC_002937.3
  ref <309>: DATABASE ENTRY DATE: 2019-04-01
  ref <313>: RELEVANT RESIDUES IN SEQ ID NO: (1)..(1541)
agagtttgattctggctcagattgaacgctggcggcgtgcttaacacatgcaagtcgcgcgtgaaagggcttcggcccgagtaaagcggcgcacgggtgagtaacgcgtggatgatctacccatgagttgggaataacggctggaaacggtcgctaataccgaatacgctccgatttcaacttcgggggaaaggtggcctctgcttgcaagctactgctcatggatgagtccgcgtcccattagctagttggtggggtaacggcccaccaaggcgacgatgggtagccggtctgagaggatgaccggccacactgggactggaacacggcccagactcctacgggaggcagcagtggggaatattgcgcaatgggcgaaagcctgacgcagcgacgccgcgtgagggatgaaggtcctcggatcgtaaacctctgtcaggagggaagaaccgccacggtgctaatcagccgtggtctgacggtacctccaaaggaagcaccggctaactccgtgccagcagccgcggtaatacggagggtgcgagcgttaatcggaatcactgggcgtaaagcgcacgtaggctgcttggtaagtcaggggtgaaagcccgcggctcaaccgcggaattgcctttgatactgccgagctagagtccgggagagggtagtggaattccaggtgtaggagtgaaatccgtagagatctggaggaacatcagtggcgaaggcgactacctggaccggtactgacgctgaggtgcgaaagcgtggggagcaaacaggattagataccctggtagtccacgccgtaaacgatggatgctaggtgtcggggccttgagcttcggtgccgtagttaacgcgttaagcatcccgcctggggagtacggtcgcaaggctgaaactcaaagaaattgacgggggcccgcacaagcggtggagtatgtggtttaattcgatgcaacgcgaagaaccttacctaggtttgacatccggaagaccttcccgaaaaggaagggtgcccttcggggaattccgagacaggtgctgcatggctgtcgtcagctcgtgccgtgaggtgttgggttaagtcccgcaacgagcgcaacccctattgccagttgctaccaggtaatgctgggcactctggtgagactgccccggttaacggggaggaaggtggggacgacgtcaagtcatcatggcccttacgcctagggctacacacgtactacaatggcgcatacaaagggcagcgataccgcgaggtggagccaatcccaaaaagtgcgtcccagtccggattgcagtctgcaactcgactgcatgaagttggaatcgctagtaattcgagatcagcatgctcgggtgaatgcgttcccgggccttgtacacaccgcccgtcacaccacgaaagttggttttacccgacaccggtgagctaaccagcaatggaggcagccgtctacggtagggccgatgattggggtgaagtcgtaacaaggtagccgtaggggaacctgcggctggatcacctcctt

SEQ ID NO: 3259 - DNA, 467 bp, Desulfovirgula thermocuniculi
  ref <308>: DATABASE ACCESSION NUMBER: NCBI ACCESSION: NZ_AUBR01000015.1
  ref <309>: DATABASE ENTRY DATE: 2019-04-01
  ref <313>: RELEVANT RESIDUES IN SEQ ID NO: (1)..(467)
ttttatggagagtttgatcctggctcaggacgaacgctggcggcgtgcctaacacatgcaagtcgagcgggctggtggtgggtgatgagtctatcatcagtttagcggcggacgggtgagtaacgcgtggataacctacccgtgagaccgggataaccctgggaaaccggggctaataccggatatactcctgctggggcatcctggtgggaggaaaggtgcttgttggtgccgcttacggatgggtccgcgtcccattagctagatggtggggtaatggcctaccatggctgcgatgggtagccggcctgagagggtgaccggccacactgggactgagacacggcccagactcctacgggaggcagcagtgggggatcttccgcaatgggcgaaagcctgacggagcgacgccgcgtgggggaggaaggccttcgggttgtaaacccttgttctgggggaagaag

SEQ ID NO: 3260 - DNA, 1568 bp, Desulfurella acetivorans
  ref <308>: DATABASE ACCESSION NUMBER: NCBI ACCESSION: NZ_CP007051.1
  ref <309>: DATABASE ENTRY DATE: 2019-04-01
  ref <313>: RELEVANT RESIDUES IN SEQ ID NO: (1)..(1568)
actgagagtttgatcctggctcagaatgaacgctggcggcgtgcctaacacatgcaagtcgtacgcgaaagaagggcaaccttcgagtaaagtggcgcacgggtgagtaacacgtggataacctgccccaaagtctgggataacgtgccgaaaggtgcgctaataccggatacctttgtgtctcacaagaggtataaagaaaggaggcctctgcttgcaagctttcgctttgggatgggtccgcggcctatcaggtagttggtagggtaacggcctaccaagcctacgacgggtagctggtctgagaggacgatcagccacattgggactgagacacggcccagactcctacgggaggcagcagtggggaatattgggcaatgggagaaatcctgacccagcaacgccgcgtggaggatgaaggccttcgggttgtaaactcctgtcagcagggaaaaagattgcaaaagctaataccttttgcagtttgatggtacctgctaaggaagcaccggctaactacgtgccagcagccgcggtaatacgtagggtgcaagcgttattcggaatcactgggcgtaaagggcgcgcaggcggttttgtaagtctaaagtgaaatccttgggcttaacccaggggctgctttagatactgcaaaactcgagttcgggaaaagcaagcggaattcctggtgaaggggtgaaatccgtagatatcaggaagaacaccagtggcgaaagcggcttgctagaacgcaactgacgcttaggcgcgaaagcgtggggagcaaacaggattagataccctggtagtccacgccctaaacgatggatgttaggcgttgggaagtacacttcccagtgccgtaagctaacgcgttaaacatcccgcctggggagtacggccgcaaggttaaaactcaaaggaattgacgggggcccgcacaagcggtggagcatgtggtttaattcgaaggtacacgaagaaccttacctgggcttgacatgctagtagtaggagcccgaaagggtaacgattcttgccttcgggcaagaaagctagcacaggtgctgcatggctgtcgtcagctcgtgtcgtgagatgttgggttaagtcccgcaacgagcgcaaccctcggcattagttgctaacaggttatgctgagcactctaatgcgaccgccggggataacccggaggaaggtggggatgacgtcaagtcatcatggcccttatgtccagggctacacacgtgctacaatgggatgtacaatgggttgcaataccgcgaggtggagctaatccctaaagcatcccacagttcggattgcactctgcaactcgagtgcatgaagctggaatcgctagtaatcaccggtcagctatacggtggtgaatacgttcccgggccttgtacacaccgcccgtcacaccatgggagttgattctactgtaagacggtaggctaacccgttaagggaggcagccgttcatggtagggtcagcgaccggggtgaagtcgtaacaaggtagccgtaggagaacctgcggctggatcacctcctttct

SEQ ID NO: 3261 - DNA, 1568 bp, Desulfurella amilsii
  ref <308>: DATABASE ACCESSION NUMBER: NCBI ACCESSION: NZ_MDSU01000018.1
  ref <309>: DATABASE ENTRY DATE: 2019-04-01
  ref <313>: RELEVANT RESIDUES IN SEQ ID NO: (1)..(1568)
actgagagtttgatcctggctcagaatgaacgctggcggcgtgcttaacacatgcaagtcgtacgtgaaagaagggcaaccttcaagtaaagtggcgcacgggtgagtaacacgtggataacctgccccaaagtctgggataacgcgccgaaaggtgcgctaataccggatacctttatgcctcataagaggtataaagaaaggaggcctctgcttgcaagcttctgctttgggatggatccgcggcctatcaggtagttggtagggtaatggcctaccaagcctacgacgggtagctggtctgagaggacgatcagccacattgggactgagacacggcccagactcctacgggaggcagcagtggggaatattgggcaatgggagaaatcctgacccagcaacgccgcgtggaggactaaggccttcgggttgtaaactcctgtcagcagggaaaaaggttataagagctaataccttttatagcttgatggtacctgcagaggaagcaccggctaactacgtgccagcagccgcggtaatacgtagggtgcaagcgttattcggaatcactgggcgtaaagggcgcgcaggcggtcttgtaagtctaaagtgaaatccttgggcttaacccatgggctgctttagatactgcaaaactcgagttcgggaaaagcaagcggaattcctggtgaaggggtgaaatccgtagatatcaggaagaacaccagtggcgaaagcggcttgctagaacgcaactgacgcttaggcgcgaaagcgtggggagcaaacaggattagataccctggtagtccacgccctaaacgatggatgttaggcgttgggaagtacacttctcagtgccgtaagctaacgcgttaaacatcccgcctggggagtacggtcgcaagattaaaactcaaaggaattgacgggggcccgcacaagcggtggagcatgtggtttaattcgaaggtacacgaagaaccttacctgggtttgacatgctagtagtaggagctcgaaagggtaacgattcttgtcttcgggcaagaaagctagcacaggtgctgcatggctgtcgtcagctcgtgtcgtgagatgttgggttaagtcccgcaacgagcgcaaccctcggcattagttgctaacaggttatgctgagcactctaatgcgaccgccggggataacctggaggaaggtggggatgacgtcaagtcatcatggcccttatgtccagggctacacacgtgctacaatgggatgtacaatgggttgcaataccgcgaggtggagctaatccccaaagcatcccacagttcggattgcactctgcaactcgagtgcatgaagctggaatcgctagtaatcaccggtcagctatacggtggtgaatacgttcccgggccttgtacacaccgcccgtcacaccatgggagttgactttactgtaagacggtaggctaacctgtaagggaggcagccgttcatggtagggccagcgaccggggtgaagtcgtaacaaggtagccgtaggagaacctgcggctggatcacctcctttcta

SEQ ID NO: 3262 - DNA, 1349 bp, Desulfuribacillus alkaliarsenatis
  ref <308>: DATABASE ACCESSION NUMBER: NCBI ACCESSION: NZ_MIJE01000019.1
  ref <309>: DATABASE ENTRY DATE: 2019-04-01
  ref <313>: RELEVANT RESIDUES IN SEQ ID NO: (1)..(1349)
taaaagatgctacggcatcacttacagatgggcccgcgtcgcattagctagttggtgaggtaacggctcaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagcgaagaaggtcttcggattgtaaagctctgtctttaaggaagaacagcctctagagggaatgctagaggtgtgacggtacttaaggaggaagccccggctaactacgtgccagcagccgcggtaatacgtagggggcaagcgttgtccggaattattgggcgtaaagcgcgcgcaggcggtcatgtaagtctgatgtgaaaatccagggctcaaccttgggactgcattggaaactgcatgacttgagggcagaagaggggagtggaattcctagtgtagcggtgaaatgcgtagatattaggaggaacaccagtggcgaaggcgactctctggtctgttactgacgctgaggcgcgaaagcgtggggagcaaacaggattagataccctggtagtccacgccgtaaacgatgagtgctatgtgttggagggtaccaccttcagtgcagtagttaacgcaataagcactccgcctggggagtacggtcgcaaggctgaaactcaaaggaattgacgggggcccgcacaagcagtggagcatgtggtttaattcgaagcaacgcgaagaaccttaccaggtcttgacatccctctgacaggtgtagagatacaccctttcttcggaacagaggtgacaggtggtgcatggttgtcgtcagctcgtgtcgtgagatgttgggttaagtcccgcaacgagcgcaacccctattattagttgccagcattaagttgggcactctaatgagactgccggtgacaaaccggaggaaggcggggatgacgtcaaatcatcatgccccttatgacctgggcaacacacgtgctacaatggatggtacaaagggtagcgaagccgcgaggtggagccaatcccataaagccattctcagttcggattgtaggctgcaactcgcctacatgaagctggaattgctagtaatcgcggatcagaatgccgcggtgaatacgttcccgggccttgtacacaccgcccgtcacaccacgagagtttgtaacacccgaagccggtggggtaacccgtaagggagctagccgtcgaaggtgggacagatgattggggtgaagtcgtaacaaggtagccgtatcggaaggtgcggctggatcacctcctttctaagga

SEQ ID NO: 3263 - DNA, 1553 bp, Desulfuribacillus stibiiarsenatis
  ref <308>: DATABASE ACCESSION NUMBER: NCBI ACCESSION: NZ_MJAT01000019.1
  ref <309>: DATABASE ENTRY DATE: 2019-04-01
  ref <313>: RELEVANT RESIDUES IN SEQ ID NO: (1)..(1553)
tttattggagagtttgatcctggctcaggacgaacgctggcggcgtgcctaatacatgcaagtcgagcggatgtgatgaagagcttgctcttctgaacattagcggcggacgggtgagtaacacgtgggtaacctggctgtaagactgggataaccccgggaaaccggagctaataccagataataagatttctcgcatgagagatttttgaaaggtgctaaggcatcacttacaaatgggcccgcggcgcattagctagttggtggggtaaaggcctaccaaggcaacgatgcgtagccgacctgagagggtgaccggccacactggaactgagacacggtccagactcctacgggaggcagcagtagggaatcttccgcaatggacgaaagtctgacggagcaacgccgcgtgagcgaagaaggtcttcggattgtaaagctctgtctttaaggaagaacagctatgagagggaatgctcatagagtgacggtacttaaggaggaagccccggctaactacgtgccagcagccgcggtaatacgtagggggcaagcgttgtccggaattattgggcgtaaagcgcgcgcaggtggccatgtaagtctgatgtgaaattctagggctcaaccttagaactgcattggaaactgcatggcttgagagcaggagagggaagtggaattcctagtgtagcggtgaaatgcgtagatattaggaggaacaccagtggcgaaggcgacttcctggcctgttactgacactgaggcgcgaaagcgtggggagcaaacaggattagataccctggtagtccacgctgtaaacgatgagtgctatgtgttggagggtaccaccttcagtgcagtagttaacgcaataagcactccgcctggggagtacggtcgcaaggctgaaactcaaaggaattgacggggacccgcacaagcagtggagcatgtggtttaattcgaagcaacgcgaagaaccttaccaaggcttgacatccctctgaccggtgtagagatacacctttccttcgggacagaggtgacaggtggtgcatggttgtcgtcagctcgtgtcgtgagatgttgggttaagtcccgcaacgagcgcaacccctattattagttgccagcattaagttgggcactctaatgagactgccggtgacaaaccggaggaaggcggggatgacgtcaaatcatcatgccccttatgtcttgggctacacacgtgctacaatggatggtacagagggaagcgaagccgcgaggtggagccaatcccaaaaagccattctcagttcggattgtaggctgcaactcgcctacatgaagctggaattgctagtaatcgcggatcagaatgccgcggtgaatacgttcccgggtcttgtacacaccgcccgtcacaccacgagagtttgtaacacccgaagccggtggggtaacccgcaagggagctagccgtcgaaggtgggatagatgattggggtgaagtcgtaacaaggtagccgtatcggaaggtgcggctggatcacctcctttct

SEQ ID NO: 3264 - DNA, 1529 bp, Desulfurispirillum indicum
  ref <308>: DATABASE ACCESSION NUMBER: NCBI ACCESSION: NC_014836.1
  ref <309>: DATABASE ENTRY DATE: 2019-04-01
  ref <313>: RELEVANT RESIDUES IN SEQ ID NO: (1)..(1529)
ttatacggagagtttgatcctggctcaggacgaacgctggcggcgtgcctaacacatgcaagtcaaggggcctttcggggccactggcgcacgggtgagtaacacgtgggtaatctgccctttggcccgggataacatctggaaacggatgctaataccggataatctcttttgagcaaacggagctttcgggttccgccgaaggatgagcccgcgcatgattagcttgttggtggggtaacggcccaccaaggcgaagatcattagccggcctgagagggtgaacggccacactgggactgagacacggcccagactcctacgggaggcagcagtggggaatattgcgcaatggacgtaagtctgacgcagcaacgccgcgtggatgacgaaggctttcgggtcgtaaagtcctttagatggtgaagaaccggtacgggagtaactgcccgtgccctgacggtagccatagaataagctccggctaaatccgtgccagcagccgcggtaatacggatggagcaagcgttgtccggaatcattgggcgtaaagggtgcgtaggcggttttttaagtctgcattgtaagttcagtgcttaacgctgaaattggtgcggaaactggaagacttgagtactgtaggggaaagcggaatgccctgtgtagaggtgaaattcgtagatatagggtggaacatcaaaagcgaaggcagctttctgggcagtaactgacgctgaggcacgaaagcgtggggagcaaacaggattagataccctggtagtccacgccgtaaacgatggatgctagatgttggcgggaatcttcctgtcagtgtcggagctaacgcaataagcatcccgcctggggagtacggtcgcaaggctgaaactcaaaggaattgacgggggcccgcacaagcggtggagcatgtggtttaattcgaagcaacgcgaagaaccttacctggtcttgacatcccgatgccgtattcagagatgtatatttcccttcggggacatcggtgacaggtgctgcatggctgtcgtcagctcgtgtcgtgagatgttgggttaagtcccgcaacgagcgcaacccctgccattagttgccatcattaagttgggcactctagtgggacagccggagtaatccggaggaaggtggggacgacgtcaagtcatcatggcccttatgaccagggctacacacgtgctacaatggcaaggacaacgggatgcgacctcgcgagagtgagccaacctcaaaaaccttgtcttagttcggattgcagtctgcaactcgactgcatgaagtcggaatcgctagtaatcgcaggtcagcatactgcggtgaatacgttcccgggccttgtacacaccgcccgtcacaccacgaaagtcggttttgccagaagcgggtgaccgaatcttcggataggagccttcgaaggcaggactggtgattggggtgaagtcgtaacaaggtagccgtatcggaaggtgcggctggatcacctcctttctaaggag

SEQ ID NO: 3265 - DNA, 285 bp, Desulfurispora thermophila
  misc_feature (110)..(110): n is a, c, g, or t
  ref <308>: DATABASE ACCESSION NUMBER: NCBI ACCESSION: NZ_AQWN01000003.1
  ref <309>: DATABASE ENTRY DATE: 2019-04-01
  ref <313>: RELEVANT RESIDUES IN SEQ ID NO: (1)..(285)
tttcatggagagtttgatcctggctcaggacgaacgctggcggcgtgcctaacacatgcaagtcgaacggtccggacgccggtcatcagacggcggacgttggggcaggnaggtattcgcggggcgaataacctgggagccctgacgactgaagtctgacgaccggcgaccggatagtggcggacgggtgagtaacacgtggataacctgcccgtaagaccgggacaactccgggaaactggagctaataccggatacatttacgccggggcatcctggtgtaaa

SEQ ID NO: 3266 - DNA, 1562 bp, Desulfurivibrio alkaliphilus
  ref <308>: DATABASE ACCESSION NUMBER: NCBI ACCESSION: NC_014216.1
  ref <309>: DATABASE ENTRY DATE: 2019-04-01
  ref <313>: RELEVANT RESIDUES IN SEQ ID NO: (1)..(1562)
aaactggagagtttgatcctggctcagattgaacgctggcggcgtgcttaacacatgcaagtcgaacgagaaaggggcttcggccctgagtagagtggcgcacgggtgagtaacgcgtaagtaacctgcccttctatctgggataacagttcgaaagggctgctaataccggatattcttgccggccataaggttggtaaggaaaggtgacctcttcttgaaagttaccgtagagggaggggcttgcgtaccattagctagttggtggggtaacggcttaccaaggcgacgatggttagcgggtttgagaggatgatccgccacactggaactgaaacacggaccagactcctacgggaggcagcagtgaggaatattgcgcaatgggggcaaccctgacgcagcgacgccgcgtgagtgaagaaggccttcgggttgtaaagctctgtcggaagggaagaacggttcaggtgttaataccatctggatttgacggtaccttcaaaggaagcaccggctaactccgtgccagcagccgcggtaatacggagggtgcgagcgttaatcggaattactgggcgtaaagggcgcgtaggcggccctgcaagtcagttgtgaaagcccacggctcaaccgtggatgtgcaattgaaactgcagggcttgagtaccggcggggaagatggaattcccggtgtagaggtgaaattcgtagatatcgggaggaataccggtggcgaaggcgatcttctggacggatactgacgctgaggcgcgaaagcgtggggagcaaacaggattagataccctggtagtccacagctgtaaacgatgtgcactagatgttgggaggaattgaccctttcagtgtcgcagctaacgcattaagtgcaccgcctggggagtacggccgcaaggttaaaactcaaaggaattgacgggggcccgcacaagcggtggagtatgtggtttaattcgacgcaacgcgcagaaccttacctgggcttgacatcccggagatctcctggaaacaggagagtgctatcattaggtagaatccggagacaggtgctgcatggctgtcgtcagctcgtgtcgtgagatgttgggttaagtcccgcaacgagcgcaaccctcgcctttagttgccatcattaagttgggcactctagagggaccgccggtgtcaaaccggaggaaggtggggatgacgtcaagtcctcatggcctttatgtccagggctacacacgtactacaatggccggtacagagggcagcgacttagcgataagtagccaatctcaaaaagccggtctcagtccggattggagtctgcaactcgactccatgaagttggaatcgctagtaatcgcggatcagcatgccgcggtgaatacgttcccgggccttgtacacaccgcccgtcacaccacgaaagtcggttgttccagaagcggttgagctaaccttttaggaggcaggctgccaaggaatgatcggtaattggggtgaagtcgtaacaaggtagccctaggggaacctggggctggatcacctccttt

SEQ ID NO: 3267 - DNA, 1577 bp, Desulfurobacterium indicum
  ref <308>: DATABASE ACCESSION NUMBER: NCBI ACCESSION: NZ_MOEN01000057.1
  ref <309>: DATABASE ENTRY DATE: 2019-04-01
  ref <313>: RELEVANT RESIDUES IN SEQ ID NO: (1)..(1577)
ttgctggagagtttgatcctggctcagcgcgaacgctggcagcgtgcctaacacatgcaagtcgtggggcagcaggcgggttcctttgggacccgtgctggcgaccggcgaacgggtgagtaacgcgtgagcaacctaccccaaggagggggataacccggggaaacccgggctaataccccatgagcgcacggtctgcatggacagtgtgaaaagggggcctctgcatagcaagctcccgccttgggatgggctcgcgtcccatcaggtagttggtgaggtaacggctcaccaagcctacgacgggtagctggtctgagaggatggccagccacaccgggactgagacacggcccggactcctacgggaggcagcagtggggaattttgggcaatgggcgcaagcctgacccagcgacgctgcgtggaggaagaagcccttcggggtgtaaactcctgtcaccggggacgatgcttactaaggttaacagccttggtaggtgacggtacccggagaggaagggacggctaactacgtgccagcagccgcggtaatacgtaggtcccgagcgttgcgcgaaattactgggcgtaaagagcgcgtaggcggctcagtaagtcagaggtgaaatcccccggctcaaccggggaactgcctctgatactgctgagctagagtccggaagaggctggcggaattcccggtgtagcggtgaaatgcgtagatatcgggaggaacaccggtggcgaaggcggccagccaggacggtactgacgctgaggcgcgaaagcgtggggagcgaaccggattagatacccgggtagtccacgctgtaaacgatgggtgctgggcgttggccacgaaggtggtcagtgccgaagctaacgcgttaagcaccccgcctggggagtacggccgcaaggctgaaactcaaaggaatagacgggggcccgcacaagcggtggagcatgtggtttaattcaatgctacgcgaagaaccttaccagggcttgacatgcagggaaaagcggctgaaaggccgtgtgccctcttttgggggcgccctgcacaggtggtacatggccgtcgtcagctcgtgccgtgaggtgttgggttaagtcccgcaacgagcgcaacccctgtccttagttgccagcgggtaaagccgggcacactaaggagactgccggcgacaagccggaggaagggggggatgacgtcaggtcagtatgccccttacgccctgggcgacacacgtgctacaatggccgggacagagggaagcgaagctgcgaggtggagcaaaacccagaaacccggtctcagttcggattgcaggctgcaactcgcctgcatgaagctggaatcgctagtaacggccggtcagccacacggccgtgaatacgttcccgggccttgtactcaccgcccgtcacaccccgaaagctggtcttaccagaagtccccgggctaacccccggaagggggaggcaggggccgaaggtagggctggtgattggggtgaagtcgtaacaaggtagccgtaggagaacctgcggctggatcacctcctttc

SEQ ID NO: 3268 - DNA, 467 bp, Desulfurobacterium sp. TC5-1
  ref <308>: DATABASE ACCESSION NUMBER: NCBI ACCESSION: NZ_ATXC01000001.1
  ref <309>: DATABASE ENTRY DATE: 2019-04-01
  ref <313>: RELEVANT RESIDUES IN SEQ ID NO: (1)..(467)
ttgctggagagtttgatcctggctcagcgcgaacgctggcagcgtgcctaacacatgcaagtcgtggggcagcaggcgggttcctttggaacccgtgctggcgaccggcgaacgggtgagtaacgcgtgagcaacctaccccaaggagggggataaccggtggaaacgccggctaataccccataagcgcacggtctgcatggactgtgtgaaaagggggcctctgcacagcaagctcccgccttgggatgggctcgcgtcccatcaggtagttggtgaggtaacggctcaccaagcctacgacgggtagctggtctgagaggatggccagccacaccgggactgagacacggcccggactcctacgggaggcagcagtggggaattttgggcaatgggcgcaagcctgacccagcgacgctgcgtggaggaagaagcccttcggggtgtaaactcctgtcaccggg

SEQ ID NO: 3269 - DNA, 1586 bp, Desulfurobacterium thermolithotrophum
  ref <308>: DATABASE ACCESSION NUMBER: NCBI ACCESSION: NC_015185.1
  ref <309>: DATABASE ENTRY DATE: 2019-04-01
  ref <313>: RELEVANT RESIDUES IN SEQ ID NO: (1)..(1586)
ttttgctggagagtttgatcctggctcagcgcgaacgctgtcggcgtgcctaacacatgcaagtcgtggggcagcaggcgggttccttttggaacccgtgctggcgaccggcgaacgggtgagtaacgcgtgagcaacctaccccgaggagggggataacccggggaaactcgggctaataccccataagcgcacgacctgcatgggctgtgtgaaaagggtggcctctgctttgcaagctgccgcctcgggatgggctcgcgtcccatcaggtagttggtgaggtaacggctcaccaagcctacgacgggtagccggcctgagagggtggtcggccacaccgggactgagacacggcccggactcctacgggaggcagcagtggggaatcttgggcaatgggcgcaagcctgacccagcgacgccgagtggaggaagaagcccttcggggtgtaaactcctgtcgccggggacgatgcgggtgtgggttaatagctcacactcgtgacggtacccggagaggaagggacggctaactacgtgccagcagccgcggtaatacgtaggtcccgagcgttgcgcgaaattactgggcgtaaagagcgcgtaggcgggccagtaagtcagaggtgaaagcccccggctcaaccggggaattgcctctgatactgctggtctagggtccggaagaggctggcggaattcccggtgtagcggtgaaatgcgtagatatcgggaggaacaccggtggcgaaggcggccagccaggacggtaccgacgctgaggcgcgaaagcgtggggagcaaaccggattagatacccgggtagtccacgctgtaaacgatgggtgctgggcgttggcaccgataggtgtcagtgccgaagctaacgcgttaagcaccccgcctggggagtacggccgcaaggctgaaactcaaaggaatagacgggggcccgcacaagcggtggagcatgtggtttaattcaatgctacgcgaagaaccttaccagggcttgacatgcggtgtgtcgtagccgaaaggctactagctaccctttgtggggtagcgcgccgcacaggtggtacatggccgtcgtcagctcgtgccgtgaggtgttgggttaagtcccgcaacgagcgcaacccctgtccctagttgccagcgggtaaagccgggcacactagggagactgccggcgataagccggaggaaggaggggatgacgtcaggtcagtatgccccttacgccctgggctacacacgtgctacaatggtcgggacagagggaagcgaagccgcgaggtggagcaaaacccaccaaacccggtcccagttcggattgcaggctgcaactcgcctgcatgaagctggaatcgctagtaacggccggtcagctacacggccgtgaatacgttcccgggccttgtactcaccgcccgtcacaccccgaaagctggctctaccagaagtccccgggctaaccctcttatgagggaggcaggggccgaaggtagggttggtgattggggtgaagtcgtaacaaggtagccgtaggagaacctgcggctggatcacctcctttt

SEQ ID NO: 3270 - DNA, 1562 bp, Desulfuromonas acetoxidans
  ref <308>: DATABASE ACCESSION NUMBER: NCBI ACCESSION: NZ_AAEW02000008.1
  ref <309>: DATABASE ENTRY DATE: 2019-04-01
  ref <313>: RELEVANT RESIDUES IN SEQ ID NO: (1)..(1562)
taactggagagtttgatcctggctcagaacgaacgctggcggcgtgcctaacacatgcaagtcgaacgagaaagtttccttcgggaaatgagtagagtggcgcacgggtgagtaacacgtggataatctgcctgataatctgggataacatttcgaaagaagtgctaataccggataagcccacagtatcttcgggtacagcgggaaaagatggcctcttcttgaaagctattgttatcagatgagtccgcggtccattagctagttggtggggtaatggcccaccaaggcgacgatggatagctggtttgagagaatgatcagccacactggaactgagacacggtccagactcctacgggaggcagcagtggggaatcttgcgcaatgggggcaaccctgacgcagcaacgccgcgtgagtgatgaaggttttcggatcgtaaagctctgtcaagagggaagaaacctttgttggctaatacccaacagaattgacggtacctctagaggaagcaccggctaactccgtgccagcagccgcggtaatacggagggtgcaagcgttgttcggaattattgggcgtaaagcgcgtgtaggcggtttgttaagtctgatgtgaaagccccgggctcaacctgggaagtgcattggaaactggcaaacttgagtacgggagaggaaagtggaatttcgagtgtaggggtgaaatccgtagatattcgaaggaacaccagtggcgaaggcggctttctggaccgatactgacgctgagacgcgaaagcgtggggagcaaacaggattagataccctggtagtccacgccgtaaacgatgggtactaggtgtcgcgggtattgacccctgcggtgccgaagctaacgcattaagtaccccgcctggggagtacggccgcaaggctaaaactcaaaggaattgacgggggcccgcacaagcggtggagcatgtggtttaattcgacgcaacgcgaagaaccttacctgggcttgacatcccgatcgtaccttatggaaacatttgggtcagttcggctggatcggtgacaggtgctgcatggctgtcgtcagctcgtgtcgtgagatgttgggttaagtcccgcaacgagcgcaacccttgtccttagttgccatcattaagttgggcactctagggagactgccggtgttaaaccggaggaaggtggggacgacgtcaagtcatcatggcccttatgtccagggctacacacgtgctacaatggtcggtacaaagggcagcgataccgtgaggtggagcgaatcccaaaaagccggtctcagttcggattggagtctgcaactcgactccatgaagttggaatcgctagtaatcgcggatcagcatgccgcggtgaatacgttcccgggccttgtacacaccgcccgtcacaccacgggagttgattgtacctgaaatcggtgggctaaccttcgggaggcagccgcttatggtatgatcggtaactggggtgaagtcgtaacaaggtagccgtaggggaacctgcggctggatcacctcctttct

SEQ ID NO: 3271 - DNA, 1561 bp, Desulfuromonas sp. DDH964
  ref <308>: DATABASE ACCESSION NUMBER: NCBI ACCESSION: NZ_CP015080.1
  ref <309>: DATABASE ENTRY DATE: 2019-04-01
  ref <313>: RELEVANT RESIDUES IN SEQ ID NO: (1)..(1561)
aactggagagtttgatcctggctcagaacgaacgctggcggcgtgcttaacacatgcaagtcgaacgtgaaagtggacttcggtccgcgagtaaagtggcgcacgggtgagtaacacgtggataatctacccaatggtcggggataacatctcgaaaggggtgctaataccggataagcccacgggaacttcggttcttgcgggaaaaggtggggaccttcgggcctaccgtcattggatgagtccgcggcccattagctagttggtagggtaacggcctaccaaggctacgatgggtagctggtctgagaggatgatcagccacactggaactgagacacggtccagactcctacgggaggcagcagtggggaattttgcgcaatgggcgaaagcctgacgcagcaacgccgcgtgagtgatgaaggccctcgggtcgtaaagctctgtcagaggggaagaacctcctgtcggttaatatccggcaggcctgacggtaccctcaaaggaagcaccggctaactccgtgccagcagccgcggtaatacggagggtgcgagcgttgttcggaattattgggcgtaaagcgcgtgtaggcggttcgttaagtctgatgtgaaagccccgggctcaacctgggaagtgcattggaaactggcgaacttgagtacgggagagggtagtggaattccgagtgtaggggtgaaatccgtagatattcggaggaacaccggtggcgaaggcggctacctggaccgatactgacgctgagacgcgaaagcgtggggagcaaacaggattagataccctggtagtccacgccgtaaacgatgggtactaggtgttgcgggtattgacccctgcagtgccgaagctaacgcattaagtaccccgcctggggagtacggtcgcaagactaaaactcaaaggaattgacgggggcccgcacaagcggtggagcatgtggtttaattcgacgcaacgcgaagaaccttacctgggtttgacatcccgatcgcaccttatggaaacataggggtcagttcggctggatcggtgacaggtgctgcatggctgtcgtcagctcgtgtcgtgagatgttgggttaagtcccgcaacgagcgcaaccctcgtccttagttgccagcatttagttgggcactctaaggagactgccggtgttaaaccggaggaaggcggggatgacgtcaagtcctcatggcccttatgtccagggctacacacgtgctacaatggccggcacaaagggcagcaagaccgcgaggtggagctaatcccaaaaagccggtctcagttcggattggagtctgcaactcgactccatgaagttggaatcgctagtaatcgtggatcagcatgccacggtgaatacgttcccgggccttgtacacaccgcccgtcacaccacgggagtcgattgtacctgaaatcggtgggctaaccttcgggaggcagccgcttatggtatggtcggtaactggggtgaagtcgtaacaaggtagccgtaggggaacctgcggctggatcacctcctttctaa

SEQ ID NO: 3272 - DNA, 827 bp, Desulfuromonas thiophila
  ref <308>: DATABASE ACCESSION NUMBER: NCBI ACCESSION: NZ_FNAQ01000032.1
  ref <309>: DATABASE ENTRY DATE: 2019-04-01
  ref <313>: RELEVANT RESIDUES IN SEQ ID NO: (1)..(827)
gaaggcggcttcctggaccgatactgacgctgagacgcgaaagcgtggggagcaaacaggattagataccctggtagtccacgccgtaaacgatgggtactaggtgttgcgggtattgacccctgcagtgccgaagctaacgcattaagtaccccgcctggggagtacggccgcaaggctaaaactcaaaggaattgacgggggcccgcacaagcggtggagcatgtggtttaattcgacgcaacgcgaagaaccttacctgggcttgacatcccgatcgtacgatatggaaacatattggtcagttcggctggatcggtgacaggtgctgcatggctgtcgtcagctcgtgtcgtgagatgttgggttaagtcccgcaacgagcgcaacccttgtccttagttgccatcattaagttgggcactctaaggagactgccggtgttaaaccggaggaaggtggggacgacgtcaagtcatcatggcccttatgtccagggctacacacgtgctacaatggccggtacaaagggcagcgataccgcaaggtggagcaaatcccaaaaagccggtctcagttcggattggagtctgcaactcgactccatgaagttggaatcgctagtaatcgcggatcagcatgccgcggtgaatacgttcccgggccttgtacacaccgcccgtcacaccacgggagttgattgtacctgaaatcggtgagctaacctttcaggaggcagccgcttatggtatggtcggtaactggggtgaagtcgtaacaaggtagccgtaggggaacctgcggctggatcacctcctttctaagga

SEQ ID NO: 3273 - DNA, 1533 bp, Dethiobacter alkaliphilus
  ref <308>: DATABASE ACCESSION NUMBER: NCBI ACCESSION: NZ_ACJM01000032.1
  ref <309>: DATABASE ENTRY DATE: 2019-04-01
  ref <313>: RELEVANT RESIDUES IN SEQ ID NO: (1)..(1533)
tttttggagagtttgatcctggctcaggacgaacgctggcggcgtgcttaacacatgcaagtcgaacggggtcctagggtagcttgctacccgaccgacctagtggcgcacgggtgagtaacacgtgggcaatctgcccggaagactgggataacagcccgaaagggctgctaataccggataccttcacggaatcgcatgattctgtgaagaaatgtatttcgcttccggatgagcccgcgtcccattagctagttggtgaggtaacggctcaccaaggcaacgatgggtagctggtctgagaggacgatcagccacactggaactgagacacggtccagactcctacgggaggcagcagtggggaatcttgcgcaatgggcgaaagcctgacgcagcaacgccgtgtgaacgatgaaggccttagggtcgtaaagttctgtcaagggggaagaagttctgacggtacccctggaggaagctccggctaactacgtgccagcagccgcggtaatacgtagggagcgagcgttgtccggaattactgggcgtaaagggcgtgtaggcggccaatcaagtcaggtgtgaaaatccaaggctcaaccttggacgtgcacttgaaactggttgacttgagtgcaggagaggaaagtggaattcccagtgtagcggtgaaatgcgtagatattgggaggaacaccagtggcgaaggcgactttctggcctgtaactgacgctgaggcgcgaaagctaggggagcaaacaggattagataccctggtagtcctagccgtaaacgatgggtactaggtgtagggggtttagatgccctctgtgccgcagttaacacattaagtaccccgcctggggagtacggccgcaaggctgaaactcaaaggaattgacgggggcccgcacaagcggtggagcatgtggtttaattcgaagcaacgcggagaaccttaccaaggcttgacatataactgccgtgctgtgaaagcagtatttctcttcggagacggttatacaggtggtgcatggttgtcgtcagctcgtgtcgtgagatgttgggttaagtcccgcaacgagcgcaacccctattgttagttgccatcattcagttgggcactctaacgagactgccggtgacaaaccggaggaaggtggggatgacgtcaaatcatcatgccccttatgtcttgggctacacacgtgctacaatggccagtacaacgggttgctaaagagcgatctggagctaatcccacaaaactggtctcagttcggattgtaggctgcaattcgcctgcatgaagctggaatcgctagtaatcgcggatcagcatgccgcggtgaatacgttcccgggccttgtacacaccgcccgtcacaccacgaaagctggcaacacccgaagccggtgggctaacccttttgggaagcagccgtcgaaggtggggttagtgattggggtgaagtcgtaacaaggtagccgtatcggaaggtgcggctggatcacctcctttctaagga

SEQ ID NO: 3274 - DNA, 1568 bp, Dethiosulfatarculus sandiegensis
  ref <308>: DATABASE ACCESSION NUMBER: NCBI ACCESSION: NZ_AZAC01000010.1
  ref <309>: DATABASE ENTRY DATE: 2019-04-01
  ref <313>: RELEVANT RESIDUES IN SEQ ID NO: (1)..(1568)
ttcaactggagagtttgatcctggctcagaacgaacgctggcggcaggcctaacacatgcaagtcgtacgagaacggttaacttcggttaacctagtaaagtggcgcacgggtgagtaacgcgtgggtaatctacctctggatttgggataacgttccgaaaggggcgctaataccaaataagactgtagccatcacgatggcatcagccaaagcgggcctatacatgtaagctcgtgtctggagatgagctcgcgtcccattagcttgttggtgaggtaacggctcaccaaggccgcgatgggtagctgatctgagaggatgatcagccacactgggactggaacacggcccagactcctacgggaggcagcagtgaggaatcttgcgcaatgggggaaaccctgacgcagccatgccgcgtgggtgaagaaggccttcgggtcgtaaagctctgtcaggtgggaagaatgttttagaggttaataccctttattattgacggtaccaccaaaggaagcaccggctaactccgtgccagcagccgcggtaatacggagggtgcaagcgttgttcggaattactgggcgtaaagagcgtgtaggcggctaagtaagtcaaatgtgaaatccctcggcttaaccgaggacgtgcatctgatactgcttagcttgagtctcggagaggggtgtggaattcccggtgtagaggtgaaattcgtagatatcgggaggaacatcagtggcgaaggcgacaccctggacgatgactgacgctgagacgcgaaagcgtgggtagcaaacaggattagataccctggtagtccacgccgtaaacggtgtcaactaggtgttgtgggtattgacccccgcagtgccgaagctaacgcattaagttgaccgcctggggagtacggccgcaaggttaaaactcaaaggaattgacggggacccgcacaagcggtggagcatgtggtttaattcgacgcaacgcgcagaaccttacctgggtttgacatcccctgacagctctagaaatagagttttcacttcggtgacagggtgacaggtgctgcatggctgtcgtcagctcgtgtcgtgagatgttgggttaagtcccgcaacgagcgcaacccctatgtctagttgccagtatttagttaggcactctagtcagactgccccggttaacggggaggaaggtggggatgacgtcaagtcctcatggcccttatgtccagggctacacacgtgctacaatggtcggtacaaagggttgcgagatcgcaaggttaagctaatcccaaaaaaccggccccagttcggattggagtctgcaactcgactccatgaagttggaatcgctagtaatcccggatcagcatgccggggtgaatacgttcccgggtcttgtacacaccgcccgtcacaccacgaaagcctgctgtaccagaagtggctaggccaacctctcacgaggaggcaggtccccaaggtatggccggtaattggggtgaagtcgtaacaaggtagccgtaggggaacctgcggctggatcacctcctttcta

SEQ ID NO: 3275 - DNA, 1536 bp, Dethiosulfovibrio peptidovorans
  ref <308>: DATABASE ACCESSION NUMBER: NCBI ACCESSION: NZ_ABTR02000001.1
  ref <309>: DATABASE ENTRY DATE: 2019-04-01
  ref <313>: RELEVANT RESIDUES IN SEQ ID NO: (1)..(1536)
ttatggagagtttgatcctggctcaggacgaacgctggcggcgtgcttaacacatgcaagtgggacgaaggtatgtacttgaaagcttcggctggacggtacatatactgagtcgcggacgggtgagtaaagcgtgaggacctgtccatcagagggggatagccccgggaaaccgggattaaaaccccataagcccaagggtgaaaaggagtaatccgctgatggagggtctcgcgtcctatcaggtagttggtggggtaaaggcctaccaagccgaagacgggtagccggactgagaggttgaccggccacattggaactgagatacggtccagactcctacgggaggcagcagtggggaatattgggcaatgggcggaagcctgacccagcgacgccgcgtgagggaagacggtcttcggattgtaaacctctgttgcaggggaagaaggaagtgacggtaccctgcgaggaagccccggcaaactacgtgccagcagccgcggtaacacgtagggggcgagcgttgtccggaattactgggcgtaaagggcgcgtaggctgcgaggcaagtcgggtgtaaaaggcacgggctcaacccgtgtgtgcactcgaaactgtcttgctggaggggtagagaggcaagcggaattcccggtgtagcggtgaaatgcgtagatatcgggaagaacaccagtggcgaaggcggcttgctggctacaccctgacgctgaggcgcgaaagccaggggagcgaaccggattagatacccgggtagtcctggcagtaaacgatgaatgctaggtgtgggtgggtcaaaccatccgtgccgcagttaacgcgataagcattccgcctggggagtacggccgcaaggttgaaactcaaaggaattgacgggggcccgcacaagcggtggagcacgtggtttaattcgatgcaaaccgaagaaccttacctgggcttgacatctaggtggtattgacctgaaaggtgatagaccatattttcggatatggagcctagacaggtgctgcatggctgtcgtcagctcgtgtcgtgagatgttgggttaagtcccgcaacgagcgcaacccctattgtcagttgctaacgattgaaggcgagcactctggcgagactgccggcgacaagccggaggaaggtggggacgacgtcaagtcatcatggcccttatgtccagggcaacacacatgctacaatggccgatacagagggaagcgaaggcgcgagttggagcggatcccacaaagtcggtcccagttcggattgcagtctgcaactcgactgcatgaagttggaatcgctagtaatcgcaaatcagctaagttgcggtgaatacgttcccgggccttgtacacaccgcccgtcacaccatccgagttgggtgcacccgaagccggaggccgaacccttagggggcggatccgtcgaaggtgtgtctggtaaggagggtgaagtcgtaacaaggtagccgtaccggaaggtgcggctggatcacctcctttctaagga

SEQ ID NO: 3276 - DNA, 1535 bp, Dethiosulfovibrio salsuginis
  ref <308>: DATABASE ACCESSION NUMBER: NCBI ACCESSION: NZ_FXBB01000068.1
  ref <309>: DATABASE ENTRY DATE: 2019-04-01
  ref <313>: RELEVANT RESIDUES IN SEQ ID NO: (1)..(1535)
ttatggagagtttgatcctggctcaggacgaacgctggcggcgtgcttaacacatgcaagtgggacgaaggttcttgtcggaaggcttcggctggaagataaggatactgagtcgcggacgggtgagtaatgcgtgagaacctgtctcaaagagggggacagccccgggaaaccgggattaataccccatatgcctaagggtgaaacggagcaatccgctttgagaggggctcgcgtcctatcagctagttggtgaggtaatggctcaccaaggcaaagacgggtagccggactgagaggttggacggccacattggaactgagatacggtccagactcctacgggaggcagcagtggggaatattgggcaatgggcgcaagcctgacccagcgacgccgcgtgagggaagacggtcttcggattgtaaacctctgttgcaggggaagaataaagtgacggtaccctgcgaggaagccccggcaaactacgtgccagcagccgcggtaacacgtagggggcgagcgttgtccggaattactgggcgtaaagggtgcgtaggctgcgagacaagtcgggtgtaaaaggcacgggctcaacctgtgtgtgcactcgaaactgttttgctggagggatagagaggcaagcggaattcccggtgtagcggtgaaatgcgtagatatcgggaagaacaccagtggcgaaggcggcttgctggctataccctgacgctgaggcacgaaagccaggggagcgaaccggattagatacccgggtagtcctggcagtaaacgatgagtgctaggtgtgggtgggtcaaaccatctgtgccgcagctaacgcattaagcactccgcctggggagtacggtcgcaagattgaaactcaaaggaattgacgggggcccgcacaagcggtggagcacgtggtttaattcgatgcaaaccgaagaaccttacctgggcttgacatttaggtggtattgacctgaaaggtgatagaccatgttttcgaatatggagcctaaacaggtgctgcatggctgtcgtcagctcgtgtcgtgagatgttgggttaagtcccgcaacgagcgcaacccctgtggtcagttgctaacgtttaaggcgagcactctggccagactgccggcgacaagccggaggaaggtggggacgacgtcaagtcatcatggcccttatgtccagggcaacacacatgctacaatggccggtacagagggaagcgaaagggcgacctggagcggatcccaaaaagccggtcccagttcggattgcagtctgcaactcgactgcatgaagttggaatcgctagtaatcgcaaatcagagaagttgcggtgaatacgttcccgggccttgtacacaccgcccgtcacaccatccgagttaggtgcacccgaagccggaggccaaacccgtaagggatggatccgtcgaaggtgtgtctggtaaggagggtgaagtcgtaacaaggtagccgtaccggaaggtgcggctggatcacctcctttctaagga

SEQ ID NO: 3277 - DNA, 1492 bp, Devosia chinhatensis
  ref <308>: DATABASE ACCESSION NUMBER: NCBI ACCESSION: NZ_JZEY01000061.1
  ref <309>: DATABASE ENTRY DATE: 2019-04-01
  ref <313>: RELEVANT RESIDUES IN SEQ ID NO: (1)..(1492)
tttcaaacttgagagtttgatcctggctcagaacgaacgctggcggcaggcttaacacatgcaagtcgaacgccccgcaaggggagtggcagacgggtgagtaacgcgtgggaatctacctagttctacggaacaacagttggaaacgactgctaataccgtatacgccctatgggggaaagatttatcggaattagatgagcccgcgtaagattagctagttggtgaggtaatggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggattgttaagtcagaggtgaaatcctggagctcaactccagaactgcctttgatactggcaatctcgagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggtcggacgatttccagagatggatctcttcacttcggtgaccgacacacaggtgctgcatggctgtcgtcagctcgtgtcgtgagatgttgggttaagtcccgcaacgagcgcaaccctcgtccttagttgccatcatttagttgggcactctaaggagactgccggtgataagccggaggaaggtggggatgacgtcaagtcatcatggcccttatgggctgggctacacacgtgctacaatggtggtgacagagggcagctagacagcgatgtcatgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3278 - DNA, 1488 bp, Devosia elaeis
  ref <308>: DATABASE ACCESSION NUMBER: NCBI ACCESSION: NZ_LVVY01000108.1
  ref <309>: DATABASE ENTRY DATE: 2019-04-01
  ref <313>: RELEVANT RESIDUES IN SEQ ID NO: (1)..(1488)
aacttgagagtttgatcctggctcagaacgaacgctggcggcaggcttaacacatgcaagtcgaacggtctcttcggaggcagtggcagacgggtgagtaacgcgtgggaatctacccagttctacggaataacgcagggaaacttgcgctaataccgtatacgccctacgggggaaagatttatcggaattggatgagcccgcgtaagattagctagttggtgaggtaatggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggatcgttaagtcagaggtgaaatcccggagctcaactccggaactgcctttgatactggcgatctcgagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttgggtggtttaccactcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggtcggacggtttccagagatggattccttcacttcggtgactgacacacaggtgctgcatggctgtcgtcagctcgtgtcgtgagatgttgggttaagtcccgcaacgagcgcaaccctcgtccttagttgccatcattcagttgggcactctaaggagactgccggtgataagccggaggaaggtggggatgacgtcaagtcatcatggcccttatgggctgggctacacacgtgctacaatggcggtgacagagggcagctacatggcgacatgatgctaatcccaaaaaaccgtctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaag

SEQ ID NO: 3279 - DNA, 1487 bp, Devosia enhydra
  ref <308>: DATABASE ACCESSION NUMBER: NCBI ACCESSION: NZ_FPKU01000005.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcttaacacatgcaagtcgaacgccccgcaaggggagtggcagacgggtgagtaacgcgtgggaatctacccagttctacggaacaactgagggaaacttcagctaataccgtatacgccctaagggggaaagatttatcggaattggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggacgataatgacggtacccacagaagaagccccggctaacttcgtgccagcagccgcggtaatacgaagggggctagcgttgttcggatttactgggcgtaaagcgcacgtaggcgggtcgttaagtcaggggtgaaatcctggagctcaactccagaactgcctttgatactggcgacctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatggaagctagccgttgggaggtttacctctcagtggcgcagctaacgcattaagcttcccgcctggggagtacggtcgcaagattaaaactcaaaggaattgacgggggcccgcacaagcggtggagcatgtggtttaattcgaagcaacgcgaagaaccttaccagctcttgacatggcaggacggttcccggagacgggttccttcacttcggtgacctgcacacaggtgctgcatggctgtcgtcagctcgtgtcgtgagatgttgggttaagtcccgcaacgagcgcaaccctcgcccttagttgccatcattcagttgggcactctagggggactgccggtgataagccggaggaaggtggggatgacgtcaagtcatcatggcccttacgggctgggctacacacgtgctacaatggcggtgacagagggcagctacatggcgacatgatgctaatcccaaaaagccgtctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgcaaggaggcagccgaccacggtagggtcagcgactggggtgaagtcgtaacaaggtagccgtaggggaacctgcggctggatcacctcctttctaagg

SEQ ID NO: 3280 - DNA, 1494 bp, Devosia epidermidihirudinis
  ref <308>: DATABASE ACCESSION NUMBER: NCBI ACCESSION: NZ_LANJ01000007.1
  ref <309>: DATABASE ENTRY DATE: 2019-04-01
  ref <313>: RELEVANT RESIDUES IN SEQ ID NO: (1)..(1494)
tttcaaacttgagagtttgatcctggctcagaacgaacgctggcggcaggcttaacacatgcaagtcgaacggtctcttcggaggcagtggcagacgggtgagtaacgcgtgggaatctacctagttctgcggaacaacagttggaaacgactgctaataccgcatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggattggtcagttaggggtgaaatcctggagctcaactccagaactgcctttaatactgccagtctagagtccggaagaggtaagtggaactcctagtgtagaggtggaattcgtagatattaggaagaacaccagtggcgaaggcggcttactggtccggtactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaagacgacttccagagatggatttcttcccttcggggacttggacacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttatgggctgggctacacacgtgctacaatggtggtgacagagggcagctagtccgcgaggacgtgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3281 - DNA, 1490 bp, Devosia geojensis
  ref <308>: DATABASE ACCESSION NUMBER: NCBI ACCESSION: NZ_JZEX01000084.1
  ref <309>: DATABASE ENTRY DATE: 2019-04-01
  ref <313>: RELEVANT RESIDUES IN SEQ ID NO: (1)..(1490)
aacttgagagtttgatcctggctcagaacgaacgctggcggcaggcttaacacatgcaagtcgaacgcactcttcggagtgagtggcagacgggtgagtaacgcgtgggaacctaccctttactacggaataactgagggaaacttcagctaataccgtatacgccctacgggggaaagatttatcggtaaaggatgggcccgcgttggattagctagttggtggggtaatggcctaccaaggcgacgatccatagctggtctgagaggatgatcagccacactgggactgagacacggcccagactcctacgggaggcagcagtggggaatattggacaatgggggaaaccctgatccagccatgccgcgtgagtgatgaaggccttagggttgtaaagctctttcagtggggaagataatgacggtacccacagaagaagccccggctaacttcgtgccagcagccgcggtaatacgaagggggctagcgttgttcggatttactgggcgtaaagcgcacgtaggcggattgttaagtcagaggtgaaatcctggagctcaactccagaactgcctttgatactggcaatctcgagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaggacggttcccagagatgggttccttcacttcggtgacctggacacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttatgggctgggctacacacgtgctacaatggcggtgacagagggcagctagacagcgatgtcatgctaatccctaaaaaccgtctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagga

SEQ ID NO: 3282 - DNA, 1487 bp, Devosia insulae
  ref <308>: DATABASE ACCESSION NUMBER: NCBI ACCESSION: NZ_LAJE02000198.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcttaacacatgcaagtcgaacgccccgcaaggggagtggcagacgggtgagtaacgcgtgggaatctacctagttctacggaacaacacagggaaacttgtgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggaagataatgacggtacccacagaagaagccccggctaacttcgtgccagcagccgcggtaatacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggaggatttatccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacggttaccagagatggtttccttcacttcggtgacctgcacacaggtgctgcatggctgtcgtcagctcgtgtcgtgagatgttgggttaagtcccgcaacgagcgcaaccctcgcccttagttgccatcatttagttgggcactctaaggggactgccggtgataagccggaggaaggtggggatgacgtcaagtcttcatggcccttacgggctgggctacacacgtgctacaatggcggtgacagagggttgctacacagcgatgtgatgctaatccctaaaagccgtctcagttcggattgcactctgcaactcgggtgcatgaagtcggaatcgctagtaatcgcagatcagcacgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3283 - DNA, 1488 bp, Devosia lucknowensis
  ref <308>: DATABASE ACCESSION NUMBER: NCBI ACCESSION: NZ_FXWK01000003.1
  ref <309>: DATABASE ENTRY DATE: 2019-04-01
  ref <313>: RELEVANT RESIDUES IN SEQ ID NO: (1)..(1488)
aacttgagagtttgatcctggctcagaacgaacgctggcggcaggcttaacacatgcaagtcgaacgccccgcaaggggagtggcagacgggtgagtaacgcgtgggaatctacccagatctacggaacaacagttggaaacgactgctaataccgtatacgccctacgggggaaagatttatcggatttggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgtcaggacgacttccagagatggattttttcccttcggggacctgaacacaggtgctgcatggctgtcgtcagctcgtgtcgtgagatgttgggttaagtcccgcaacgagcgcaaccctcgtccttagttgccatcatttagttgggcactctaaggagactgccggtgataagccggaggaaggtggggatgacgtcaagtcatcatggcccttatgggctgggctacacacgtgctacaatggtggtgacagagggcagctagacagcgatgtcatgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaagccggtgcgctaaccgcaaggaagcagccgaccacggtagggtcagcgactggggtgaagtcgtaacaaggtagccgtaggggaacctgcggctggatcacctcctttctaagga

SEQ ID NO: 3284 - DNA, 1492 bp, Devosia psychrophila
  ref <308>: DATABASE ACCESSION NUMBER: NCBI ACCESSION: NZ_FOMB01000028.1
  ref <309>: DATABASE ENTRY DATE: 2019-04-01
  ref <313>: RELEVANT RESIDUES IN SEQ ID NO: (1)..(1492)
tttcaaacttgagagtttgatcctggctcagaacgaacgctggcggcaggcttaacacatgcaagtcgaacgctccgcaaggagagtggcagacgggtgagtaacgcgtgggaatctacctagttctacggaacaacagttggaaacgactgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggaagataatgacggtacccacagaagaagccccggctaacttcgtgccagcagccgcggtaatacgaagggggctagcgttgttcggatttactgggcgtaaagcgcacgtaggcggattggtaagttaggggtgaaatcctggagctcaactccagaactgcctttaatactgccagtctagagtccggaagaggtaagtggaactcctagtgtagaggtggaattcgtagatattaggaagaacaccagtggcgaaggcggcttactggtccggtactgacgctgaggtgcgaaagcgtggggagcaaacaggattagataccctggtagtccacgccgtaaactatgagagctagccgttgggagatttatctctcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaagacgacttccagagatggatttcttcccttcggggacttggacacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttatgggctgggctacacacgtgctacaatggtggtgacagagggcagctacacagcgatgtgatgctaatcccaaaaagccatctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgtaaggaagcagccgaccacggtagggtcagcgactggggtgaagtcgtaacaaggtagccgtaggggaacctgcggctggatcacctcctttctaagg

SEQ ID NO: 3285 - DNA, 1491 bp, Devosia riboflavina
  ref <308>: DATABASE ACCESSION NUMBER: NCBI ACCESSION: NZ_JQGC01000043.1
  ref <309>: DATABASE ENTRY DATE: 2019-04-01
  ref <313>: RELEVANT RESIDUES IN SEQ ID NO: (1)..(1491)
attaaacttgagagtttgatcctggctcagaacgaacgctggcggcaggcttaacacatgcaagtcgaacgccccgcaaggggagtggcagacgggtgagtaacgcgtgggaatctacctagttctacggaacaacagttggaaacgactgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacgatttccagagatggatctcttcacttcggtgacctgcacacaggtgctgcatggctgtcgtcagctcgtgtcgtgagatgttgggttaagtcccgcaacgagcgcaaccctcgtccttagttgccatcatttagttgggcactctaaggagactgccggtgataagccggaggaaggtggggatgacgtcaagtcatcatggcccttatgggctgggctacacacgtgctacaatggcggtgacagagggcagctagaccgcgaggtcatgctaatcccaaaaagccgtctcagttcggattgcactctgcaactcgggtgcatgaagttggaatcgctagtaatcgcagatcagcatgctgcggtgaatacgttcccgggccttgtacacaccgcccgtcacaccatgggaattggttctacccgaagccggtgcgctaaccgtaaggaagcagccgaccacggtagggtcagtgactggggtgaagtcgtaacaaggtagccgtaggggaacctgcggctggatcacctcctttctaagg

SEQ ID NO: 3286 - DNA, 1492 bp, Devosia soli
  ref <308>: DATABASE ACCESSION NUMBER: NCBI ACCESSION: NZ_LAJG01000011.1
  ref <309>: DATABASE ENTRY DATE: 2019-04-01
  ref <313>: RELEVANT RESIDUES IN SEQ ID NO: (1)..(1492)
attaaacttgagagtttgatcctggctcagaacgaacgctggcggcaggcttaacacatgcaagtcgaacgcatcgcaagatgagtggcagacgggtgagtaacgcgtgggaatctacctagttctacggaacaacagttggaaacgactgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaggacgacttccagagatggatttctctccttcgggagcctggacacaggtgctgcatggctgtcgtcagctcgtgtcgtgagatgttgggttaagtcccgcaacgagcgcaaccctcgttcctagttgccatcatttagttgggcactctagggagactgccggtgataagccggaggaaggtggggatgacgtcaagtcatcatggcccttatgggctgggctacacacgtgctacaatggcggtgacagagggcagctagaccgcgaggtcatgctaatcccaaaaagccgtctcagttcggattgcactctgcaactcgggtgcatgaagttggaatcgctagtaatcgcagatcagcatgctgcggtgaatacgttcccgggccttgtacacaccgcccgtcacaccatgggaattggttctacccgaagccggtgcgctaaccgcaaggaagcagccgaccacggtagggtcagtgactggggtgaagtcgtaacaaggtagccgtaggggaacctgcggctggatcacctcctttctaagga

SEQ ID NO: 3287 - DNA, 1487 bp, Devosia sp. 1566
  ref <308>: DATABASE ACCESSION NUMBER: NCBI ACCESSION: NZ_CP034767.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcttaacacatgcaagtcgaacggtctcttcggaggcagtggcagacgggtgagtaacgcgtgggaatctacctagttctacggaacaacagagggaaacttctgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggaagataatgacggtacccacagaagaagccccggctaacttcgtgccagcagccgcggtaatacgaagggggctagcgttgttcggatttactgggcgtaaagcgcacgtaggcggatcgttaagtcagaggtgaaatcctggagctcaactccagaactgcctttgatactggcgatctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggagggtttacccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaagacgacttccggagacggatttcttcccttcggggacttggacacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttatgggctgggctacacacgtgctacaatggtggtgacagagggcagctagtccgcgaggacgtgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggaattggttctacccgaagccggtgcgctaaccgcaaggaagcagccgaccacggtagggtcagtgactggggtgaagtcgtaacaaggtagccgtaggggaacctgcggctggatcacctcctttctaa

SEQ ID NO: 3288 - DNA, 1493 bp, Devosia sp. 17-2-E-8
  ref <308>: DATABASE ACCESSION NUMBER: NCBI ACCESSION: NZ_JQGB01000056.1
  ref <309>: DATABASE ENTRY DATE: 2019-04-01
  ref <313>: RELEVANT RESIDUES IN SEQ ID NO: (1)..(1493)
attaaacttgagagtttgatcctggctcagaacgaacgctggcggcaggcttaacacatgcaagtcgaacgccccgcaaggggagtggcagacgggtgagtaacgcgtgggaatctacccagttcttcggaataacacagggaaacttgtgctaataccggatacgccctacgggggaaagatttatcggaattggatgagcccgcgtaagattagctagttggtgaggtaatggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggattgttaagttaggggtgaaatcccagggctcaaccctggaactgcctttaatactggcaatctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttgggatgtttacatctcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatcccggtcgcggttttcagagatgaattccttcagttcggctggaccggtgacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttacgggctgggctacacacgtgctacaatggcggtgacagagggcagctacacggcgacgtgatgctaatccctaaaaaccgtctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggttaagtcgtaacaaggtagccgtaggggaacctgcggctggatcacctcctttctaagg

SEQ ID NO: 3289 - DNA, 1487 bp, Devosia sp. A16
  ref <308>: DATABASE ACCESSION NUMBER: NCBI ACCESSION: NZ_CP012945.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcttaacacatgcaagtcgaacgccccgcaaggggagtggcagacgggtgagtaacgcgtgggaatctacccagttctacggaacaactgagggaaacttcagctaataccgtatacgccctacgggggaaagatttatcggaattggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggacgataatgacggtacccacagaagaagccccggctaacttcgtgccagcagccgcggtaatacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggaggatttatccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacggttaccagagatggtttccttcacttcggtgacctgcacacaggtgctgcatggctgtcgtcagctcgtgtcgtgagatgttgggttaagtcccgcaacgagcgcaaccctcgcccttagttgccatcatttagttgggcactctaaggggactgccggtgataagccggaggaaggtggggatgacgtcaagtcttcatggcccttacgggctgggctacacacgtgctacaatggcggtgacagagggttgctacacagcgatgtgatgctaatccctaaaagccgtctcagttcggattgcactctgcaactcgggtgcatgaagtcggaatcgctagtaatcgcagatcagcacgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3290 - DNA, 1493 bp, Devosia sp. DBB001
  ref <308>: DATABASE ACCESSION NUMBER: NCBI ACCESSION: NZ_CCAO010000029.1
  ref <309>: DATABASE ENTRY DATE: 2019-04-01
  ref <313>: RELEVANT RESIDUES IN SEQ ID NO: (1)..(1493)
attaaacttgagagtttgatcctggctcagaacgaacgctggcggcaggcttaacacatgcaagtcgaacgccccgcaaggggagtggcagacgggtgagtaacgcgtgggaatctacccagttcttcggaataacacagggaaacttgtgctaataccggatacgccctacgggggaaagatttatcggaattggatgagcccgcgtaagattagctagttggtgaggtaatggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggattgttaagttaggggtgaaatcccagggctcaaccctggaactgcctttaatactggcaatctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttgggatgtttacatctcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatcccggtctcggttttcagagatgaattccttcagttcggctggaccggtgacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttacgggctgggctacacacgtgctacaatggcggtgacagagggcagctacacggcgacgtgatgctaatccctaaaaaccgtctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3291 - DNA, 1493 bp, Devosia sp. H5989
  ref <308>: DATABASE ACCESSION NUMBER: NCBI ACCESSION: NZ_CP011300.1
  ref <309>: DATABASE ENTRY DATE: 2019-04-01
  ref <313>: RELEVANT RESIDUES IN SEQ ID NO: (1)..(1493)
attaaacttgagagtttgatcctggctcagaacgaacgctggcggcaggcttaacacatgcaagtcgaacgccccgcaaggggagtggcagacgggtgagtaacgcgtgggaatctacccagttcttcggaataactgagggaaacttcagctaataccggatacgccctacgggggaaagatttatcggaattggatgagcccgcgtaagattagctagttggtgaggtaacggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggattgttaagttaggggtgaaatcccagggctcaaccctggaactgcctttaatactggcaatctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttgggaagtttacttctcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatcccggtcgcggttttcagagatgaattccttcagttcggctggaccggtgacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttacgggctgggctacacacgtgctacaatggcggtgacagagggcagctacacagcgatgtgacgctaatccctaaaaaccgtctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3292 - DNA, 1486 bp, Devosia sp. I507
  ref <308>: DATABASE ACCESSION NUMBER: NCBI ACCESSION: NZ_CP026747.1
  ref <309>: DATABASE ENTRY DATE: 2019-04-01
  ref <313>: RELEVANT RESIDUES IN SEQ ID NO: (1)..(1486)
aacttgagagtttgatcctggctcagaacgaacgctggcggcaggcttaacacatgcaagtcgaacgccccttcgggggagtggcagacgggtgagtaacgcgtgggaatctacccagttctacggaacaacagttggaaacgactgctaataccgtatacgccctacgggggaaagatttatcggaattggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggtttgttaagtcagaggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttgggtggtttaccactcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggtcggacggttttcagagatgaattccttcacttcggtgactgacacacaggtgctgcatggctgtcgtcagctcgtgtcgtgagatgttgggttaagtcccgcaacgagcgcaaccctcgtccttagttgccatcatttagttgggcactctaaggagactgccggtgataagccggaggaaggtggggatgacgtcaagtcatcatggcccttatgggctgggctacacacgtgctacaatggtggtgacagagggcagctagacggcgacgtcgtgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaagccggtgcgctaaccttagggaagcagccgaccacggtagggtcagcgactggggtgaagtcgtaacaaggtagccgtaggggaacctgcggctggatcacctcctttctaag

SEQ ID NO: 3293 - DNA, 1494 bp, Devosia sp. LC5
  ref <308>: DATABASE ACCESSION NUMBER: NCBI ACCESSION: NZ_JNNO01000045.1
  ref <309>: DATABASE ENTRY DATE: 2019-04-01
  ref <313>: RELEVANT RESIDUES IN SEQ ID NO: (1)..(1494)
tttcaaacttgagagtttgatcctggctcagaacgaacgctggcggcaggcttaacacatgcaagtcgaacggtctcttcggaggcagtggcagacgggtgagtaacgcgtgggaatctacctagttctacggaacaacagagggaaacttctgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggaagataatgacggtacccacagaagaagccccggctaacttcgtgccagcagccgcggtaatacgaagggggctagcgttgttcggatttactgggcgtaaagcgcacgtaggcggattggtcagttagaggtgaaatcccgaagctcaacttcggaactgcctttaatactgccagtctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttgggtggtttaccactcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacgatttccggagacggatttcttcacttcggtgacctgcacacaggtgctgcatggctgtcgtcagctcgtgtcgtgagatgttgggttaagtcccgcaacgagcgcaaccctcgttcctagttgccatcatttagttgggcactctagggagactgccggtgataagccggaggaaggtggggatgacgtcaagtcatcatggcccttatgggctgggctacacacgtgctacaatggtggtgacagagggcagctagtccgcgaggacgtgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3294 - DNA, 1491 bp, Devosia sp. Leaf420
  ref <308>: DATABASE ACCESSION NUMBER: NCBI ACCESSION: NZ_LMQU01000010.1
  ref <309>: DATABASE ENTRY DATE: 2019-04-01
  ref <313>: RELEVANT RESIDUES IN SEQ ID NO: (1)..(1491)
attaaacttgagagtttgatcctggctcagaacgaacgctggcggcaggcttaacacatgcaagtcgaacgccccgcaaggggagtggcagacgggtgagtaacgcgtgggaatctacctagttctacggaacaacagttggaaacgactgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaagacgacttccagagatggatttcttcccttcggggacttggacacaggtgctgcatggctgtcgtcagctcgtgtcgtgagatgttgggttaagtcccgcaacgagcgcaaccctcgttcctagttgccatcatttagttgggcactctagggagactgccggtgataagccggaggaaggtggggatgacgtcaagtcatcatggcccttatgggctgggctacacacgtgctacaatggtggtgacagagggcagctagaccgcgaggtcatgctaatcccaaaaagccatctcagttcggattgcactctgcaactcgggtgcatgaagttggaatcgctagtaatcgcagatcagcatgctgcggtgaatacgttcccgggccttgtacacaccgcccgtcacaccatgggaattggttctacccgaagccggtgcgctaaccgtaaggaagcagccgaccacggtagggtcagtgactggggtgaagtcgtaacaaggtagccgtaggggaacctgcggctggatcacctcctttctaagg

SEQ ID NO: 3295 - DNA, 1491 bp, Devosia sp. Leaf64
  ref <308>: DATABASE ACCESSION NUMBER: NCBI ACCESSION: NZ_LMLO01000013.1
  ref <309>: DATABASE ENTRY DATE: 2019-04-01
  ref <313>: RELEVANT RESIDUES IN SEQ ID NO: (1)..(1491)
attaaacttgagagtttgatcctggctcagaacgaacgctggcggcaggcttaacacatgcaagtcgaacgccccgcaaggggagtggcagacgggtgagtaacgcgtgggaatctacctagttctacggaacaacagttggaaacgactgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttggatggtttaccattcagtggcccagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaagacgacttccagagatggatttcttcccttcggggacttggacacaggtgctgcatggctgtcgtcagctcgtgtcgtgagatgttgggttaagtcccgcaacgagcgcaaccctcgttcctagttgccatcatttagttgggcactctagggagactgccggtgataagccggaggaaggtggggatgacgtcaagtcatcatggcccttatgggctgggctacacacgtgctacaatggtggtgacagagggcagctagaccgcgaggtcatgctaatcccaaaaagccatctcagttcggattgcactctgcaactcgggtgcatgaagttggaatcgctagtaatcgcagatcagcatgctgcggtgaatacgttcccgggccttgtacacaccgcccgtcacaccatgggaattggttctacccgaagccggtgcgctaaccgtaaggaagcagccgaccacggtagggtcagtgactggggtgaagtcgtaacaaggtagccgtaggggaacctgcggctggatcacctcctttctaagg

SEQ ID NO: 3296 - DNA, 1320 bp, Devosia sp. M6-77
  ref <308>: DATABASE ACCESSION NUMBER: NCBI ACCESSION: NZ_UZWD01000003.1
  ref <309>: DATABASE ENTRY DATE: 2019-04-01
  ref <313>: RELEVANT RESIDUES IN SEQ ID NO: (1)..(1320)
aagggggaaagatttatcggaattggatgagcccgcgttggattagctagttggtgaggtaatggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttgggtggtttaccactcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggtcggacggttaccagagatggtttccttcacttcggtgactgacacacaggtgctgcatggctgtcgtcagctcgtgtcgtgagatgttgggttaagtcccgcaacgagcgcaaccctcgttcttagttgccatcatttagttgggcactctaaggagactgccggtgataagccggaggaaggtggggatgacgtcaagtcatcatggcccttatgggctgggctacacacgtgctacaatggcggtgacagagggcagctacatggcgacatgatgctaatcccaaaaaaccgtctcagttcggattgcactctgcaactcgggtgcatgaagttggaatcgctagtaatcgcagatcagcatgctgcggtgaatacgttcccgggccttgtacacaccgcccgtcacaccatgggagttggttttacccgaagccggtgcgctaaccgcaaggaagcagccgaccacggtagggtcagcgactggggtgaagtcgtaacaaggtagccgtaggggaacctgcggctggatcacctcctttctaag

SEQ ID NO: 3297 - DNA, 1487 bp, Devosia sp. PTEAB7WZ
  ref <308>: DATABASE ACCESSION NUMBER: NCBI ACCESSION: NZ_QENV01000015.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcttaacacatgcaagtcgaacgcactcttcggagtgagtggcagacgggtgagtaacgcgtgggaatctacccagttctacggaacaacagttggaaacgactgctaataccgtatacgccctacgggggaaagatttatcggaattggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggtttgttaagtcagaggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttgggtggtttaccactcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaggacggttcccagagatgggttccttcacttcggtgacctggacacaggtgctgcatggctgtcgtcagctcgtgtcgtgagatgttgggttaagtcccgcaacgagcgcaaccctcgttcctagttgccatcatttagttgggcactctagggagactgccggtgataagccggaggaaggtggggatgacgtcaagtcatcatggcccttatgggctgggctacacacgtgctacaatggtggtgacagagggcagctagacggcgacgtcatgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaagccggtgcgctaaccttagggaagcagccgaccacggtagggtcagcgactggggtgaagtcgtaacaaggtagccgtaggggaacctgcggctggatcacctcctttctaa

SEQ ID NO: 3298 - DNA, 1487 bp, Devosia sp. Root105
  ref <308>: DATABASE ACCESSION NUMBER: NCBI ACCESSION: NZ_LMCR01000020.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcttaacacatgcaagtcgaacgccccgcaaggggagtggcagacgggtgagtaacgcgtgggaatctacccagttctacggaacaacacagggaaacttgtgctaataccgtatacgccctacgggggaaagatttatcggaattggatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtggggacgataatgacggtacccacagaagaagccccggctaacttcgtgccagcagccgcggtaatacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggaggatttatccttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacggtttccggagacggattccttcacttcggtgacctgcacacaggtgctgcatggctgtcgtcagctcgtgtcgtgagatgttgggttaagtcccgcaacgagcgcaaccctcgcccttagttgccatcatttagttgggcactctaaggggactgccggtgataagccggaggaaggtggggatgacgtcaagtcttcatggcccttacgggctgggctacacacgtgctacaatggcggtgacagagggttgctacacagcgatgtgatgctaatccctaaaagccgtctcagttcggattgcactctgcaactcgggtgcatgaagtcggaatcgctagtaatcgcagatcagcacgctgcggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3299 - DNA, 1487 bp, Devosia sp. Root413D1; identical to SEQ ID NO: 3298
  ref <308>: DATABASE ACCESSION NUMBER: NCBI ACCESSION: NZ_LMEA01000010.1
  ref <309>: DATABASE ENTRY DATE: 2019-04-01
  ref <313>: RELEVANT RESIDUES IN SEQ ID NO: (1)..(1487)

SEQ ID NO: 3300 - DNA, 1493 bp, Devosia sp. Root436
  ref <308>: DATABASE ACCESSION NUMBER: NCBI ACCESSION: NZ_LMEM01000012.1
  ref <309>: DATABASE ENTRY DATE: 2019-04-01
  ref <313>: RELEVANT RESIDUES IN SEQ ID NO: (1)..(1493)
tttcaaacttgagagtttgatcctggctcagaacgaacgctggcggcaggcttaacacatgcaagtcgaacgctccgcaaggagagtggcagacgggtgagtaacgcgtgggaatctacctagttctacggaacaacagagggaaacttctgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactsctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcccttgatactggcaagctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggaaggtttacctttcagtggcgcagctaacgcattaagctctccgsctggggagtacggtcgcaagattaaaactcaaaggaattgacgggggcccgcacaagcggtggagcatgtggtttaattcgaagcaacgcgaagaaccttaccagcccttgacatgccaggacggttcccagagatgggttccttctcttcggagacttggacacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttatgggctgggctacacacgtgctacaatggtggtgacagagggcagctagtccgcgaggacgtgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgtaaggaagcagccgaccacggtagggtcagcgactggggtgaagtcgtaacaaggtagccgtaggggaacctgcggctggatcacctcctttctaagga

SEQ ID NO: 3301 - DNA, 1493 bp, Devosia sp. Root635
  ref <308>: DATABASE ACCESSION NUMBER: NCBI ACCESSION: NZ_LMGZ01000002.1
  ref <309>: DATABASE ENTRY DATE: 2019-04-01
  ref <313>: RELEVANT RESIDUES IN SEQ ID NO: (1)..(1493)
tttcaaacttgagagtttgatcctggctcagaacgaacgctggcggcaggcttaacacatgcaagtcgaacgccccgcaaggggagtggcagacgggtgagtaacgcgtgggaatctacctagttctacggaacaacacagggaaacttgtgctaataccgtatacgccctacgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcagtagggaagataatgacggtacctacagaagaagccccggctaacttcgtgccagcagccgcggtaatacgaagggggctagcgttgttcggatttactgggcgtaaagcgcacgtaggcggtttgttaagtcaggggtgaaatcccggagctcaactccggaactgcccttgatactggcaagctagagtccggaagaggtgagtggaactcctagtgtagaggtggaattcgtagatattaggaagaacaccagtggcgaaggcggctcactggtccggtactgacgctgaggtgcgaaagcgtggggagcaaacaggattagataccctggtagtccacgccgtaaactatgagagctagccgttggaaggtttacctttcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatgccaggacgacttccagagatggatttcttcacttcggtgacctggacacaggtgctgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcatcatggcccttatgggctgggctacacacgtgctacaatggtggtgacagagggcagctagtccgcgaggacgtgctaatcccaaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaagccggtgcgctaaccgtaaggaagcagccgaccacggtagggtcagcgamtggggtgaagtcgtaacaaggtagccgtaggggaacctgcggctggatcacctcctttctaagga

SEQ ID NO: 3302 - DNA, 1487 bp, Devosia sp. Root685
  ref <308>: DATABASE ACCESSION NUMBER: NCBI ACCESSION: NZ_LMHK01000002.1
  ref <309>: DATABASE ENTRY DATE: 2019-04-01
  ref <313>: RELEVANT RESIDUES IN SEQ ID NO: (1)..(1487)
aacttgagagtttgatcctggctcagaacgaacgctggcggcaggcttaacacatgcaagtcgaacgccccgcaaggggagtggcagacgggtgagtaacgcgtgggaatctacctagttctacggaacaacagttggaaacgactgctaataccgtatacgccctacgggggaaagatttatcggaattagatgagcccgcgtaagattagctagttggtgaggtaatggctcaccaaggcgacgatctttagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggatttactgggcgtaaagcgcacgtaggcggtttgttaagtcagaggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacaggattagataccctggtagtccacgccgtaaactatgagagctagccgttggatggtttaccattcagtggcgcagctaacgcattaagctctccgcctggggagtacggtcgcaagattaaaactcaaaggaattgacgggggcccgcacaagcggtggagcatgtggtttaattcgaagcaacgcgaagaaccttaccagcccttgacatggcaggacgatttccagagatggatctcttcacttcggtgacctgcacacaggtgctgcatggctgtcgtcagctcgtgtcgtgagatgttgggttaagtcccgcaacgagcgcaaccctcgtccttagttgccatcatttagttgggcactctaaggagactgccggtgataagccggaggaaggtggggatgacgtcaagtcatcatggcccttatgggctgggctacacacgtgctacaatggcggtgacagagggcagctagaccgcgaggtcatgctaatcccaaaaagccgtctcagttcggattgcactctgcaactcgggtgcatgaagttggaatcgctagtaatcgcagatcagcatgctgcggtgaatacgttcccgggccttgtacacaccgcccgtcacaccatgggaattggttctacccgaagccggtgcgctaaccgtaaggaagcagccgaccacggtagggtcagtgactggggtgaagtcgtaacaaggtagccgtaggggaacctgcggctggatcacctcctttctaagg

SEQ ID NO: 3303 - DNA, 1575 bp, Dialister invisus
  ref <308>: DATABASE ACCESSION NUMBER: NCBI ACCESSION: NZ_GG698602.1
  ref <309>: DATABASE ENTRY DATE: 2019-04-01
  ref <313>: RELEVANT RESIDUES IN SEQ ID NO: (1)..(1575)
atggagagtttgatcctggctcaggacgaacgctggcggcgtgcttaacacatgcaagtcgaacgaaaagagggaaagagcttgctctttccggaattgagtggcaaacgggtgagtaacacgtaaacaacctgccttcaggatggggacaacagacggaaacgactgctaataccgaataagttccaagagccgcatggcccatggaagaaaaggtggcctctacctgtaagctatcgcctgaagaggggtttgcgtctgattagctggttggaggggtaacggcccaccaaggcgacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaaactctgtgatccgggacgaaaaggcagagtgcgaagaacaaactgcattgacggtaccggaaaagcaagccacggctaactacgtgccagcagccgcggtaatacgtaggtggcaagcgttgtccggaattattgggcgtaaagcgcgcgcaggcggcttcccaagtccctcttaaaagtgcggggcttaaccccgtgatgggaaggaaactgggaagctggagtatcggagaggaaagtggaattcctagtgtagcggtgaaatgcgtagagattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgcgatctgcagaaatgcggagttcttcttcggaagacgagaaaacaggtggtgcacggctgtcgtcagctcgtgtcgtgagatgttgggttaagtcccgcaacgagcgcaacccctatcatttgttaccagcacgtaaaggtggggactcaaatgagaccgccgcggacaacgcggaggaaggcggggacgacgtcaagtcatcatgccccttatgacctgggctacacacgtactacaatgggtgtcaacaaagagaagcgaacccgcgaggaagagcaaacctcaaaaacacacccccagttcagatcgcaggctgcaacccgcctgcgtgaagtaggaatcgctagtaatcgcgggtcagcataccgcggtgaatacgttcccgggccttgtacacaccgcccgtcacactatgagagtcagaaacacccgaagccggtgaggtaaccgcaaggagccagccgtcgaaggcggagctgatgattggagtgaagtcgtaacaaggtagccgtatcggaaggtgcggctggatcacctcctttctaaggaga

SEQ ID NO: 3304 - DNA, 1573 bp, Dialister micraerophilus
  ref <308>: DATABASE ACCESSION NUMBER: NCBI ACCESSION: NZ_GL878521.1
  ref <309>: DATABASE ENTRY DATE: 2019-04-01
  ref <313>: RELEVANT RESIDUES IN SEQ ID NO: (1)..(1573)
atggagagtttgatcctggctcaggacgaacgctggcggcgtgcttaacacatgcaagtcgaacgagaggacatgaaaagcttgctttttatgaaatctagtggcaaacgggtgagtaacacgtaaacaacctgccttcaagatggggacaacagacggaaacgactgctaataccgaatacgatccgaaagtcgcatgacatttggatgaaagggtggcctatcgaagaagctatcgcttgaagaggggtttgcgtccgattaggtagttggtgaggtaacggcccaccaagccgacgatcggtagccggtctgagaggatgaacggccacactggaactgagacacggtccagactcctacgggaggcagcagtggggaatcttccgcaatggacgaaagtctgacggagcaacgccgcgtgagtgaagacggccttcgggttgtaaagctctgtgattcgggacgaaaggccatatgtgaataatatatggaaatgacggtaccgaaaaagcaagccacggctaactacgtgccagcagccgcggtaatacgtaggtggcaagcgttgtccggaattattgggcgtaaagcgcgcgcaggcggtcacttaagtccatcttagaagtgcggggcttaaccccgtgatgggatggaaactgggagactggagtatcggagaggaaagtggaattcctagtgtagcggtgaaatgcgtagatattaggaagaacaccggtggcgaaggcgactttctggacgaaaactgacgctgaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagtcttgacattgatcgccattccaagagattggaagttctccttcgggagacgagaaaacaggtggtgcacggctgtcgtcagctcgtgtcgtgagatgttgggttaagtcccgcaacgagcgcaacccctatcttttgttgccagcacgtagaggtgggaactcagaagagaccgccgcagacaatgcggaggaaggtggggatgacgtcaagtcatcatgccccttatgacttgggctacacacgtactacaatgggctttaacaaagagcagcgaaaccgcgaggtggagcgaaactcaaaaacaagcccccagttcagatcgcaggctgcaactcgcctgcgtgaagcaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggggctgatgattggagtgaagtcgtaacaaggtagccgtatcggaaggtgcggctggatcacctcctttctaaggaga

SEQ ID NO: 3305 - DNA, 1577 bp, Dialister pneumosintes
  ref <308>: DATABASE ACCESSION NUMBER: NCBI ACCESSION: NZ_QWKU01000001.1
  ref <309>: DATABASE ENTRY DATE: 2019-04-01
  ref <313>: RELEVANT RESIDUES IN SEQ ID NO: (1)..(1577)
atggagagtttgatcctggctcaggacgaacgctggcggcgtgcttaacacatgcaagtcgaacggaaagagatgaaagagcttgctcttttattaatttcagtggcaaacgggtgagtaacacgtaaacaacctgccttaaggatggggataacagacggaaacgactgctaataccgaatacgttctaagcatcgcatggtgcatagaagaaagggtggcctctacaagaaagctatcgccttaagaggggtttgcgactgattaggtagttggtgaggtaacggctcaccaagccgacgatcagtagccggtctgagaggatgaacggccacactggaactgagacacggtccagactcctacgggaggcagcagtggggaatcttccgcaatggacgaaagtctgacggagcaacgccgcgtgaacgaagaaggtcttcggattgtaaagttctgtgattcgggacgaaagggtttgtggtgaataatcatagacattgacggtaccgaaaaagcaagccacggctaactacgtgccagcagccgcggtaatacgtaggtggcaagcgttgtccggaattattgggcgtaaagcgcgcgcaggcggcttcttaagtccatcttaaaagcgtggggctcaaccccatgaggggatggaaactgggaagctggagtatcggagaggaaagtggaattcctagtgtagcggtgaaatgcgtagagattaggaagaacaccggtggcgaaggcgactttctagacgaaaactgacgctgaggcgcgaaagcgtggggagcaaacaggattagataccctggtagtccacgccgtaaacgatggatactaggtgtaggaggtatcgacccctcctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaagccttgacattgatcgcaatccatagaaatatggagttcttcttcggaagacgagaaaacaggtggtgcacggctgtcgtcagctcgtgtcgtgagatgttgggttaagtcccgcaacgagcgcaacccctatttcctgttaccagcacgtaaaggtggggactcaggagagaccgccgcggacaacgcggaggaaggcggggatgacgtcaagtcatcatgccccttatggcttgggctacacacgtactacaatgggtgccaacaaagagaagcgaaatcgcgagatggagcggacctcataaacgcacccccagttcagattgcaggctgcaactcgcctgcatgaagtaggaatcgctagtaatcgcgggtcagcataccgcggtgaatacgttcccgggccttgtacacaccgcccgtcacactatgagagttagagacacccgaagccggtgaggtaaccgcaagggaccagccgtctaaggtggagctgatgattggagtgaagtcgtaacaaggtagccgtatcggaaggtgcggctggatcacctcctttctaaggaga

SEQ ID NO: 3306 - DNA, 1567 bp, Dialister sp. Marseille-P5638
  ref <308>: DATABASE ACCESSION NUMBER: NCBI ACCESSION: NZ_LT996885.1
  ref <309>: DATABASE ENTRY DATE: 2019-04-01
  ref <313>: RELEVANT RESIDUES IN SEQ ID NO: (1)..(1567)
atggagagtttgatcctggctcaggacgaacgctggcggcgtgcttaacacatgcaagtcgaacgggaggaaaagagaagcttgcttctttttgaatctagtggcaaacgggtgagtaacacgtaaacaacctgccttcaggatggggacaacagacggaaacgactgctaataccgaatgtgttccggagaccgcatgatttccggaagaaaggatggcctctatttataagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatggacgaaagtctgacggagcaacgccgcgtgagtgatgacggccttcgggttgtaaagctctgtgatcggggacgaatggctggtatgctaataccatatcagagtgacggtacccgaatagcaagccacggctaactacgtgccagcagccgcggtaatacgtaagtggcaagcgttgtccggaattattgggcgtaaagcgcgcgcaggcggcttcttaagtccatcttaaaagtgcggggcttaaccccgtgatgggatggaaactgggaggctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgactgcaatcccgagaaatcgggagttcccttcggggacaggaaaacaggtggtgcacggctgtcgtcagctcgtgtcgtgagatgttgggttaagtcccgcaacgagcgcaacccctatcttatgttgccagcacgtaatggtgggaactcatgagagaccgccgcggacaacgcggaggaaggcggggatgacgtcaagtcatcatgccccttatgacctgggctacacacgtactacaatgggtgtcaacaaagagaagcaatggggcgacccggagcaaacctcaaaaacacacccccagttcagattgcaggctgcaacccgcctgcatgaagcaggaatcgctagtaatcgcgggtcagcataccgcggtgaatacgttcccgggccttgtacacaccgcccgtcacactatgagagtcagaaacacccgaagccggtgaggtaaccgtaaggagccagccgtcgaaggcggagctgatgattggagtgaagtcgtaacaaggtagccgtatcggaaggtgcggctggatcacctcctttcta

SEQ ID NO: 3307 - DNA, 1575 bp, Dialister succinatiphilus
  ref <308>: DATABASE ACCESSION NUMBER: NCBI ACCESSION: NZ_JH591187.1
  ref <309>: DATABASE ENTRY DATE: 2019-04-01
  ref <313>: RELEVANT RESIDUES IN SEQ ID NO: (1)..(1575)
atggagagtttgatcctggctcaggacgaacgctggcggcgtgcttaacacatgcaagtcgaacgagaggacaagagaagcttgcttcttttggaatcgagtggcaaacgggtgagtaacacgtaaacaacctgccttcaggatggggacaacagacggaaacgactgctaataccgaatacacttggaagaccgcatgatcttccaaggaaagggtggcctctacctgtaagctatcgcctgaagaggggtttgcgtctgattaggcagttggtgaggtaacggcccaccaaacctacgatcagtagccggtctgagaggatgaacggccacactggaactgagacacggtccagactcctacgggaggcagcagtggggaatcttccgcaatgggcgaaagcctgacggagcaacgccgcgtgagtgatgacggccttcgggttgtaaagctctgtgatcggggacgaacggcccgtaagctaataccttatggaagtgacggtacccgaatagcaagccacggctaactacgtgccagcagccgcggtaatacgtaggtggcaagcgttgtccggaattattgggcgtaaagcgcgcgcaggcggctttctaagtccatcttaaaagtgcggggcttaaccccgtgatgggatggaaactggaaagctggagtatcggagaggaaagtggaattcctagtgtagcggtgaaatgcgtagagattaggaagaacaccggtggcgaaggcgactttctggacgacaactgacgctgaggcgcgaaagcgtggggagcaaacaggattagataccctggtagtccacgccgtaaacgatgaatactaggtgtaggaggtatcgaccccttctgtgccggagctaacacaataagtattccgcctgggaagtacgatcgcaagattaaaactcaaaggaattgacgggggcccgcacaagcggtggagtatgtggtttaattcgacgcaacgcgaagaaccttaccaggtcttgacattgatcgccattcacagaaatgtgaagttctccttcgggagacgagaaaacaggtggtgcacggctgtcgtcagctcgtgtcgtgagatgttgggttaagtcccgcaacgagcgcaacccctatcttatgttaccagcacgttatggtggggactcatgagagaccgccgcggacaacgcggaggaaggtggggatgacgtcaagtcatcatgccccttatgacctgggctacacacgtactacaatgggtgtcaacaaagagaagcaaaaccgcgaggtggagcgaacctcaaaaacacacccccagttcagattgcaggctgcaacccgcctgcatgaagtaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggagctgatgattggagtgaagtcgtaacaaggtagccgtatcggaaggtgcggctggatcacctcctttctaaggaga

SEQ ID NO: 3308 - DNA, 1403 bp, Diaphorobacter nitroreducens
  ref <308>: DATABASE ACCESSION NUMBER: NCBI ACCESSION: NZ_RJVL01000011.1
  ref <309>: DATABASE ENTRY DATE: 2019-04-01
  ref <313>: RELEVANT RESIDUES IN SEQ ID NO: (1)..(1403)
gatcgtgggggataacgaggcgaaagctttgctaataccgcatacgatctacggatgaaagcgggggatcttaggacctcgcgcggacggagcggccgatggcagattaggtagttggtgggataaaagcttaccaagccgacgatctgtagctggtctgagaggatgatcagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaaagcctctttctaataaagaggggtcatgacggtaccgtaagaataagcaccggctaactacgtgccagcagccgcggtaatacgtagggtgcaagcgttaatcggaattactgggcgtaaagcgtgcgcaggcggttttgtaagacagaggtgaaatccccgggctcaacctgggaactgcctttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatggcaggaagtttccagagatggattcgtgcccgaaagggaacctgcacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagctaatcccataaagccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtaggtagcctaaccgtaaggagggcgcttaccacggcagggttcgtgactggggtgaagtcgtaacaaggtagccgtatcggaaggtgcggctggatcacctcctttctg

SEQ ID NO: 3309 - DNA, 1538 bp, Dichelobacter nodosus
  ref <308>: DATABASE ACCESSION NUMBER: NCBI ACCESSION: NZ_CP031475.1
  ref <309>: DATABASE ENTRY DATE: 2019-04-01
  ref <313>: RELEVANT RESIDUES IN SEQ ID NO: (1)..(1538)
ttgaactgaagagtttgattctggctcagattgaacgctggcggcatgcttaacacatgcaagtcgaacggggttatgtagcttgctatgtaacctagtggcggacgggtgagtaatatataggaatctgccttatggtgggggacaacgtatggaaacgtacgctaataccgcataagattgaagaatgaaagcgggggctcgaaagacctcgcgccgtaagatgagcctatatcggattagctagttggtggggtaagagcctaccaaggcgacgatccgtagctggtttgagagaatgatcagccacatcgggactgagacacggcccgaactcctacgggaggcagcagtggggaatattggacaatggggggaaccctgatccagcaatgccgcgtgtgtgaagaaggccttcgggttgtaaagcacttttattagtgaagaacggtgcatggttaatacccatgcaattgacattagctaaggaaaaagcaccggctaactccgtgccagcagccgcggtaatacggagggtgcaagcgttattcggaatgactgggcgtaaagcgcacgcaggtggttttataagtcaggtgtgaaatccctgggctcaacctaggaattgcatttgaaaccgtaagactagagtatgtcagaggaaggcggaatttccagtgtagcagtgaaatgcgtagatattggaaggaacaccgatggcgaaggcagccttctggggcaatactgacactcatgtgcgaaagcgtgggtagcaaacaggattagataccctggtagtccacgccctaaacgatgtcaactaggtgttgggtagaaatactcggtaccgaagctaacgcaataagttgaccgcctggggagtacggccgcaaggttgaaactcaaagaaattgacggggacccgcacaagcggtggagcatgtggtttaattcgatgcaacgcgaagaaccttaccaggctttgacatccagagaattctacagagatgtgggagtgccttcgggaactctgagacaggtgttgcatggctgtcgtcagctcgtgtcgtgagatgttgggttaagtcccgcaacgagcgcaacccttatccttacttgccagcacgtaaaggtgggaactataaggagactgccggtgacaaaccggaggaaggtggggatgacgtcaagtcatcatggcccttacagcctgggctacacacgtgctacaatgggcggtacagacggtagccaacccgcgagggggagccaatctgagaaaaccgttcgtagtccggattgcagtctgcaactcgactgcatgaagtcggaatcgctagtaatcgcgaatcagcacgtcgcggtgaatacgttcccgggtcttgtacacactgcccgtcacaccatgggagtttgttgcaccagaagtaggtagcttaaccgtaaggagggcgcttaccacggtgtggccgatgactggggtgaagtcgtaacaaggtaaccgtaggggaacctgcggttggatcacctcctttaaa

SEQ ID NO: 3310 - DNA, 1487 bp, Dichotomicrobium thermohalophilum
  ref <308>: DATABASE ACCESSION NUMBER: NCBI ACCESSION: NZ_QXDF01000001.1
  ref <309>: DATABASE ENTRY DATE: 2019-04-01
  ref <313>: RELEVANT RESIDUES IN SEQ ID NO: (1)..(1487)
tcaatctgagagtttgatcctggctcagaacgaacgctggcggcaggcctaacacatgcaagtcgaacgcaccttcgggtgagtggcagacgggtgagtaacgcgtgggaacctgccctgtggtacggaataaccctgggaaaccggggctaataccgtatacgccctacgggggaaagatttatcgccataggatgggcccgcgtcagattagctagttggtggggtaacagcctaccaaggcgacgatctgtagctggtttgagaggatgatcagccacactgggactgagacacggcccagactcctacgggaggcagcagtggggaatcttggacaatgggcgaaagcctgatccagccatgccgcgtgagtgaagaaggccctagggttgtaaagctctttcagcggggaagataatgacggtacccgcagaagaagccccggctaacttcgtgccagcagccgcggtaatacgaagggggctagcgttgttcggaattactgggcgtaaagcgcgcgtaggcggattggccagtcaggggtgaaagcccggggcttaacctcggaactgcccttgatactgccagtctagagtccggcagaggtgagtggaattcctagtgtagaggtgaaattcgtagatattaggaagaacaccagtggcgaaggcggctcactgggccgagactgacgctgaggcgcgaaagcgtggggagcaaacaggattagataccctggtagtccacgccgtaaacgatggatgctagccgttgggcagcatgctgttcagtggcgcagctaacgcattaagcatcccgcctggggagtacggccgcaaggctaaaactcaaaggaattgacgggggcccgcacaagcggtggagcatgtggtttaattcgaggcaacgcgaagaaccttaccagcccttgacatcccgtcgcggatccagagatgggtccttcggttcggccggacggtgacaggtgctgcatggctgtcgtcagctcgtgtcgtgagatgttgggttaagtcccgcaacgagcgcaacccttgtccctagttgccagcattaagttgggcactctagggagactgccagtgataagctggaggaaggtggggatgacgtcaagtcatcatggcccttacgggctgggctacacacgtgctacaatggtggtgacagtgggcagctactccgcgaggagatgctaatctctaaaagccacctcagttcggattgcactctgcaactcgagtgcatgaagttggaatcgctagtaatcgtggatcagcatgccacggtgaatacgttcccgggccttgtacacaccgcccgtcacaccatgggagttggtcttacccgaagacggtgcgctaaccttcgggaggcagccggccacggtaagatcagcgactggggtgaagtcgtaacaaggtagccgtaggggaacctgcggctggatcacctcctttctaagg

SEQ ID NO: 3311 - DNA, 1547 bp, Dickeya dadantii
  ref <308>: DATABASE ACCESSION NUMBER: NCBI ACCESSION: NZ_CP023467.1
  ref <309>: DATABASE ENTRY DATE: 2019-04-01
  ref <313>: RELEVANT RESIDUES IN SEQ ID NO: (1)..(1547)
aaattgaagagtttgatcatggctcagattgaacgctggcggcaggcctaacacatgcaagtcgagcggcagcggggggaagcttgcttccccgccggcgagcggcggacgggtgagtaatgtctggggatctgcctgatggagggggataactactggaaacggtagctaataccgcataacgtcgcaagaccaaagtgggggaccttcgggcctcacgccatcggatgaacccagatgggattagctagtaggtgaggtaacggctcacctaggcgacgatccctagctggtctgagaggatgaccagccacactggaactgagacacggtccagactcctacgggaggcagcagtggggaatattgcacaatgggggaaaccctgatgcagccatgccgcgtgtgtgaagaaggccttcgggttgtaaagcactttcagcggggaggaaggcgacaaggttaataaccttgtcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaaccctgtagagatacgggggtgccttcgggaacgctgagacaggtgctgcatggctgtcgtcagctcgtgttgtgaaatgttgggttaagtcccgcaacgagcgcaacccttatcctctgttgccagcacttcgggtgggaactcaggggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3312 - DNA, 1549 bp, Dickeya fangzhongdai
  ref <308>: DATABASE ACCESSION NUMBER: NCBI ACCESSION: NZ_CP020872.1
  ref <309>: DATABASE ENTRY DATE: 2019-04-01
  ref <313>: RELEVANT RESIDUES IN SEQ ID NO: (1)..(1549)
aaattgaagagtttgatcatggctcagattgaacgctggcggcaggcctaacacatgcaagtcgagcggcagcggggggaagcttgcttccccgccggcgagcggcggacgggtgagtaatgtctggggatctgcctgatggagggggataactactggaaacggtagctaataccgcataacgtcgcaagaccaaagtgggggaccttcgggcctcacgccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggggaaaccctgatgcagccatgccgcgtgtgtgaagaaggccttcgggttgtaaagcactttcagcggggaggaaggcggtaaggttaataaccttgtcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaagactgcagagatgcggtcgtgccttcgggaacgctgagacaggtgctgcatggctgtcgtcagctcgtgttgtgaaatgttgggttaagtcccgcaacgagcgcaacccttatcctctgttgccagcactacgggtgggaactcaggggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgagct

SEQ ID NO: 3313 - DNA, 1548 bp, Dickeya solani
  ref <308>: DATABASE ACCESSION NUMBER: NCBI ACCESSION: NZ_CP024710.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgagcggcagcggggggaagcttgcttccccgccggcgagcggcggacgggtgagtaatgtctggggatctgcctgatggagggggataactactggaaacggtagctaataccgcataacgtcgcaagaccaaagtgggggaccttcgggcctcacgccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggggaaaccctgatgcagccatgccgcgtgtgtgaagaaggccttcgggttgtaaagcactttcagcggggaggaaggcgataaggttaataaccctgtcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagagggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttggcagagatgccttagtgccttcgggagctctgagacaggtgctgcatggctgtcgtcagctcgtgttgtgaaatgttgggttaagtcccgcaacgagcgcaacccttatcctttgttgccagcacttcgggtgggaactcaagggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3314 - DNA, 1547 bp, Dickeya sp. FVG1-MFV-O17
  ref <308>: DATABASE ACCESSION NUMBER: NCBI ACCESSION: NZ_RJLR01000052.1
  ref <309>: DATABASE ENTRY DATE: 2019-04-01
  ref <313>: RELEVANT RESIDUES IN SEQ ID NO: (1)..(1547)
aaattgaagagtttgatcatggctcagattgaacgctggcggcaggcctaacacatgcaagtcgagcggcagcggggggaagcttgcttccccgccggcgagcggcggacgggtgagtaatgtctgggaaactgcctgatggagggggataactactggaaacggtagctaataccgcataacgtcttcggaccaaagtgggggctcttcggacctcacgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggggatagagttaatacctttatccattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaaccctgtagagatacgggggtgccttcgggaacgctgagacaggtgctgcatggctgtcgtcagctcgtgttgtgaaatgttgggttaagtcccgcaacgagcgcaacccttatcctttgttgccagcacttcgggtgggaactcaagggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3315 - DNA, 1547 bp, Dickeya sp. FVG10-MFV-A16
  ref <308>: DATABASE ACCESSION NUMBER: NCBI ACCESSION: NZ_RJLS01000033.1
  ref <309>: DATABASE ENTRY DATE: 2019-04-01
  ref <313>: RELEVANT RESIDUES IN SEQ ID NO: (1)..(1547)
aaattgaagagtttgatcatggctcagattgaacgctggcggcaggcctaacacatgcaagtcgagcggtagcggggggaagcttgcttccccgccggcgagcggcggacgggtgagtaatgtctgggaaactgcctgatggagggggataactactggaaacggtagctaataccgcataacgtcttcggaccaaagtgggggctcttcggacctcacgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggggatagagttaatacctttatccattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaaccctgtagagatacgggggtgccttcgggaacgctgagacaggtgctgcatggctgtcgtcagctcgtgttgtgaaatgttgggttaagtcccgcaacgagcgcaacccttatcctttgttgccagcacttcgggtgggaactcaagggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3316 - DNA, 334 bp, Dickeya sp. NCPPB 569
  ref <308>: DATABASE ACCESSION NUMBER: NCBI ACCESSION: NZ_AOOD01000061.1
  ref <309>: DATABASE ENTRY DATE: 2019-04-01
  ref <313>: RELEVANT RESIDUES IN SEQ ID NO: (1)..(334)
cgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3317 - DNA, 1547 bp, Dickeya sp. S29
  ref <308>: DATABASE ACCESSION NUMBER: NCBI ACCESSION: NZ_QNUT01000063.1
  ref <309>: DATABASE ENTRY DATE: 2019-04-01
  ref <313>: RELEVANT RESIDUES IN SEQ ID NO: (1)..(1547)
aaattgaagagtttgatcatggctcagattgaacgctggcggcaggcctaacacatgcaagtcgagcggtagcacaaaggagcttgctccttgggtgacgagcggcggacgggtgagtaatgtctgggaaactgcctgatggagggggataactactggaaacggtagctaataccgcataacgtcttcggaccaaagagggggaccttcgggcctcttgccatcagatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgataaggctaataaccttgtcgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaagcctgcagagatgcgggtgtgccttcgggagctctgagacaggtgctgcatggctgtcgtcagctcgtgttgtgaaatgttgggttaagtcccgcaacgagcgcaacccttatcctctgttgccagcacttcgggtgggaactcaggggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3318 - DNA, 1549 bp, Dickeya sp. Secpp 1600
  ref <308>: DATABASE ACCESSION NUMBER: NCBI ACCESSION: NZ_CP023484.1
  ref <309>: DATABASE ENTRY DATE: 2019-04-01
  ref <313>: RELEVANT RESIDUES IN SEQ ID NO: (1)..(1549)
aaattgaagagtttgatcatggctcagattgaacgctggcggcaggcctaacacatgcaagtcgagcggcagcggggggaagcttgcttccccgccggcgagcggcggacgggtgagtaatgtctggggatctgcctgatggagggggataactactggaaacggtagctaataccgcatgacgtcgcaagaccaaagtgggggaccttcgggcctcacgccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggggaaaccctgatgcagccatgccgcgtgtgtgaagaaggccttcgggttgtaaagcactttcagcggggaggaaggcggcaaggttaataaccttaccgattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaagactgcagagatgcggtcgtgccttcgggaacgctgagacaggtgctgcatggctgtcgtcagctcgtgttgtgaaatgttgggttaagtcccgcaacgagcgcaacccttatcctctgttgccagcactacgggtgggaactcaggggagactgccggtgataaaccggaggaaggtggggatgacgtcaagtcatcatggcccttacgagtagggctacacacgtgctacaatggcgtatacaaagagaagcgacctcgtgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgagct

SEQ ID NO: 3319 - DNA, 1548 bp, Dickeya zeae
  ref <308>: DATABASE ACCESSION NUMBER: NCBI ACCESSION: NZ_CP025799.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgagcggcagcggggggaagcttgcttccccgccggcgagcggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtgaggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagggagcagacttaatacgtctgttcattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaagcctgcagagatgcgggtgtgccttcgggagctctgagacaggtgctgcatggctgtcgtcagctcgtgttgtgaaatgttgggttaagtcccgcaacgagcgcaacccttatcctttgttgccagcacgttatggtgggaactcaagggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3320 - DNA, 1480 bp, Dictyobacter aurantiacus
  ref <308>: DATABASE ACCESSION NUMBER: NCBI ACCESSION: NZ_BIFQ01000001.1
  ref <309>: DATABASE ENTRY DATE: 2019-04-01
  ref <313>: RELEVANT RESIDUES IN SEQ ID NO: (1)..(1480)
ggatggcgagtttgatcctggctcaggataaacgctggcggcgtgcctaacacatgcaagtcgaacgccctacgcaagtagggagtggcggacgggtgaggaacacgtgggtcatctgccctggggtgaggaataccggcgagaaatcgccgacaataccgcatagcttcgtaagaagaaagctcgcaagagcgcccgaggatgagcctgcgctcgattagttggttggtggggtaatggcctaccaagaccgcgatcgatagctggtctgagaggacgatcagccacactgggattgagaacggcccagactcctacggggggcagcagtgaggaattttcgtcaatgggggcaaccctgaacgagcaacgccgcgtgcaggaagacggttttcggatcgtaaactgcttttctctgggacgagaacggacggtaccagaggaatcagcctcggctaactacgtgccagcagccgcggtaatacgtaggaggcgagcgttgtccggagttactgggcgtaaagcgcacgcaggcggtcaggtaagtctgtggtgacagtcgtcggctcaactgacgaagtactacggaaactgtctgacttgagggcttcagagggacacggaattccgggtggagtggtgaaatgcgtagatatccggaggaacaccaaaggcgaaggcagtgtcctgggaagtacctgacgctcaggtgcgaaagctaggggagcgaacaggattagataccctggtagtcctagccgtaaacgatgaccactagacgttgggggtatcgaccccttcagtgtcgtagttaacacaataagtggtccgcctggggagtacggtcgcaagattaaaactcaaaggaattgacggggacccgcacaagcagcggagcgtgtggtttaattcgatgcaacgcgaagaaccttaccaaggcttgacatgaacctgcaccagccgtaacgggctgtcccttcggggcgggttcacaggtgctgcatggctgtcgtcagctcgtgtcgtgagatgttgggttaagtcccgcaacgagcgcaacccctgtcgttagttggatttttctagcgaaactgccgttataagacggaggaaggcggggatgacgtcaagtcagcacggcccttacgctttgggcgacacacacgctacaatggtcaggacaaagagttgcgaacccgcgagggggagctaatctcgtcaaacctggcctcagttcagattggaggctgcaacccgcctccatgaagttggagttgctagtaaccgtaggtcagcacactacggtgaatacgttcccgggtcttgtacacaccgcccgtcacaccacgaaagttggcaacacttgaagccgctgggctaacccatctgggaggcaagcgtcgagggtggggtcagtgattggggtgaagtcgtaacaaggtagccgtaccggaaggtgcggctggatcacctcctttct

SEQ ID NO: 3321 - DNA, 1545 bp, Dictyoglomus thermophilum
  ref <308>: DATABASE ACCESSION NUMBER: NCBI ACCESSION: NC_011297.1
  ref <309>: DATABASE ENTRY DATE: 2019-04-01
  ref <313>: RELEVANT RESIDUES IN SEQ ID NO: (1)..(1545)
ggagggtttgatcctggctcaggacgaacgctggcggcgtgcctaaggcatgcaagtcgagcggtagctcctattggtttatgccgataggagtgagagcggcgcacgggtgagtaacacgtaggtaacctaccccagagagggggataacacctcgaaaggggtgctaaacccccatatacttaccgagcgatatgctcaggtaaggaaagagtatagaggggtaaccctctatgctgctctgggatgggcctgcggcctatcagctagttggtggggtaatggcccaccaaggctaagacgggtagccggcctgagagggtggtcggccacactgggactgagacacggcccagactcctacgggaggcagcagccgggaatcttccgcaatgggggaaaccctgacggagcgacgccgcgtgagggaagaagcccttcggggtgtaaacctcttttctcggggaagaatactgacggtacccgaggaaaaagccccggctaactacgtgccagcagccgcggtaagacgtagggggcgagcgttgtccggatttactgggcgtaaagggcgtgtaggcggcttagcaagtcagatgtggaagccctgagctcaactcagggaggtcatctgatactgctaagctagagggcaggagaggagagcggaacttccggtgtagcggtgaaatgcgtagatatcggaaggaacgccggtggcgaaggcggctctctggactgaccctgacgctgaggcgcgaaagctaggggagcgaacgggattagataccccggtagtcctagccgtaaacgatgggcactaggtgtggggagttagactctccgtgctgcagctaacgcgataagtgccccgcctggggagtacggccgcaaggctaaaactcaaaggaattgacgggggcccgcacaagcggtggagcgcgtggtttaattcgatgctaagcgaagaaccttaccagggcttgacatgcaggctgtaagctcactcgaaagggtgagtgccaaataggggggtttcccctatttggagcctgcacaggtggtgcatggctgtcgtcagctcgtgtcgtgagatgttgggttaagtcccgcaacgagcgcaacccctgcccttagttgccagcgggtaaagccgggcactctaaggggactgccggcgaagagccggaggaaggtggggatgacgtcaagtcagtatgccccttatgccctgggctacacacgcgctacaatgggtggtacagaggggagcgaagccgcgaggcggagcgaatccctaaagccacccccagttcagatcgcaggctgcaactcgcctgcgtgaaggcggaatcgctagtaaccgcagatcagccacgctgcggtgaatacgttctcgggccttgtacacaccgcccgtcacaccacgagagtccgcaacacccgaagtcaggcgaagagcctgccgaaggtggggcggatgattggggtgaagtcgtaacaaggtagccgtaccggaaggtgcggctggatcacctcctttct

SEQ ID NO: 3322 - DNA, 1541 bp, Dictyoglomus turgidum
  ref <308>: DATABASE ACCESSION NUMBER: NCBI ACCESSION: NC_011661.1
  ref <309>: DATABASE ENTRY DATE: 2019-04-01
  ref <313>: RELEVANT RESIDUES IN SEQ ID NO: (1)..(1541)
ggagggtttgatcctggctcaggacgaacgctggcggcgtgcctaaggcatgcaagtcgagcggtagctcctattggttaaagccgataggagtgagagcggcgcacgggtgagtaacacgtaggtaacctaccccagagagggggataacacctcgaaaggggtgctaaacccccatatacttaccgagcgagatgctcaggtaaggaaagggtatagaggggtaaccctctatgctgctctgggatgggcctgcggcctatcagctagttggtggggtaaaggcccaccaaggctaagacgggtagccggcctgagagggtggtcggccacactgggactgagacacggcccagactcctacgggaggcagcagccgggaatcttccgcaatgggggaaaccctgacggagcgacgccgcgtgagggaagaagcccttcggggtgtaaacctcttttctcggggaagaaggcatgacggtacccgaggaaaaagccccggctaactacgtgccagcagccgcggtaagacgtagggggcgagcgttgtccggatttactgggcgtaaagggcgtgtaggcggcttagcaagtcagatgtggaagccccgggctcaactcggggaggacatctgatactgctaagctagagggcaggagaggagagcggaacttccggtgtagcggtgaaatgcgtagatatcggaaggaacgccggtggcgaaggcggctctctggactgtccctgacgctgaggcgcgaaagctaggggagcgaacgggattagataccccggtagtcctagccgtaaacgatgggcactaggtgtggggagttagactctccgtgctgcagctaacgcgataagtgccccgcctggggagtacggccgcaaggctaaaactcaaaggaattgacgggggcccgcacaagcggtggagcgcgtggtttaattcgatgctaagcgaagaaccttaccagggcttgacatgcaggctgtaagctcacccgaaagggtgagtgccaaataggaggtttctcctatttggagtctgcacaggtggtgcatggctgtcgtcagctcgtgtcgtgagatgttgggttaagtcccgcaacgagcgcaacccctgcccttagttgccagcgggtaaagccgggcactctaaggggactgccggcgaagagccggaggaaggtggggatgacgtcaagtcagtatgccccttatgccctgggctacacacgcgctacaatgggtggtacagaggggagcgaagccgcgaggcggagcgaatccctaaagccacccccagttcagatcgcaggctgcaactcgcctgcgtgaaggcggaatcgctagtaaccgcagatcagccacgctgcggtgaatacgttctcgggccttgtacacaccgcccgtcacaccacgagagtccgcaacacccgaagtcaggcgaagagcctgccgaaggtggggcggatgattggggtgaagtcgtaacaaggtagccgtaccggaaggtgcggctggatcacctcct

SEQ ID NO: 3323 - DNA, 1541 bp, Dielma fastidiosa
  ref <308>: DATABASE ACCESSION NUMBER: NCBI ACCESSION: NZ_QRQL01000004.1
  ref <309>: DATABASE ENTRY DATE: 2019-04-01
  ref <313>: RELEVANT RESIDUES IN SEQ ID NO: (1)..(1541)
caaatggagagtttgatcctggctcaggatgaacgctggcggcatgcctaatacatgcaagtcgaacgaagtgaagatagcttgctattggaacttagtggcgaacgggtgagtaacacgtagataacctgcctgtatgactgggataacagttggaaacgactgctaataccggataggcagagaggaggcatctcttctctgttaaagttgggacacaacgcaaacagatggatctgcggtgcattagctagttggtgaggtaacggcccaccaaggcgatgatgcatagccggcctgagagggcgaacggccacattgggactgagacacggcccaaactcctacgggaggcagcagtagggaattttcggcaatgggggaaaccctgaccgagcaatgccgcgtgagtgaagacggccttcgggttgtaaagctctgttgtaagggaagaacggcatagagagggaatgctctatgagtgacggtaccttaccagaaagccacggctaactacgtgccagcagccgcggtaatacgtaggtggcaagcgttatccggaattattgggcgtaaagggtgcgtaggcggcgagataagtctgaggtaaaagcccgtggctcaaccacggtaagccttggaaactgtctggctggagtgcaggagaggacaatggaattccatgtgtagcggtaaaatgcgtagatatatggaggaacaccagtggcgaaggcggttgtctggcctgtaactgacgctgaagcacgaaagcgtggggagcaaataggattagataccctagtagtccacgccgtaaacgatgagaactaagtgttggggaaactcagtgctgcagttaacgcaataagttctccgcctggggagtatgcacgcaagtgtgaaactcaaaggaattgacgggggcccgcacaagcggtggagtatgtggtttaattcgacgcaacgcgaagaaccttaccaggccttgacatggtatcaaaggccctagagatagggagatagtaatggtacacacaggtggtgcatggttgtcgtcagctcgtgtcgtgagatgttgggttaagtcccgcaacgagcgcaacccttgtttctagttaccaacagtaagatggggactctagagagactgccggtgacaaaccggaggaaggtggggatgacgtcaaatcatcatgccccttatggcctgggctacacacgtactacaatggcgtctacaaagagcagcgagcaggtgactgtaagcgaatctcataaaggacgtctcagttcggattgaagtctgcaactcgacttcatgaagtcggaatcgctagtaatcgcggatcagcatgccgcggtgaatacgttctcgggccttgtacacaccgcccgtcaaaccatgggagttgataatacccgaagccggtggcctaaccagtaatggagggagccgtcgaaggtaggatcgatgactggggttaagtcgtaacaaggtatccctacgggaacgtggggatggatcacctcctttctaagga

SEQ ID NO: 3324 - DNA, 1526 bp, Dietzia kunjamensis
  ref <308>: DATABASE ACCESSION NUMBER: NCBI ACCESSION: NZ_RAQB01000007.1
  ref <309>: DATABASE ENTRY DATE: 2019-04-01
  ref <313>: RELEVANT RESIDUES IN SEQ ID NO: (1)..(1526)
ttttatggagagtttgatcctggctcaggacgaacgctggcggcgtgcttaacacatgcaagtcgaacggtaaggccccttcgggggtacacgagtggcgaacgggtgagtaacacgtgggtaatctgccctgcacttcgggataagcctgggaaaccgggtctaataccggatatgaactcctgccgcatggtgggggttggaaagtttttcggtgcaggatgagcccgcggcctatcagcttgttggtggggtaatggcctaccaaggcgacgacgggtagccggcctgagagggtgatcggccacactgggactgagacacggcccagactcctacgggaggcagcagtggggaatattgcacaatgggcgaaagcctgatgcagcgacgccgcgtgggggatgacggtcttcggattgtaaacccctttcagtagggacgaagcgcaagtgacggtacctgcagaagaagcaccggctaactacgtgccagcagccgcggtaatacgtagggtgcgagcgttgtccggaattactgggcgtaaagagctcgtaggcggtttgtcacgtcgtctgtgaaatccctcggcttaaccgggggcgtgcaggcgatacgggcagacttgagtactacaggggagactggaattcctggtgtagcggtgaaatgcgcagatatcaggaggaacaccggtggcgaaggcgggtctctgggtagtaactgacgctgaggagcgaaagcatgggtagcgaacaggattagataccctggtagtccatgccgtaaacggtgggcgctaggtgtggggtccttccacggactccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctaggcttgacatatacaggacgacggcagagatgtcgtttcccttgtggcttgtatacaggtggtgcatggttgtcgtcagctcgtgtcgtgagatgttgggttaagtcccgcaacgagcgcaacccctgtctcatgttgccagcacgtaatggtggggactcgtgagagactgccggggtcaactcggaggaaggtggggatgacgtcaaatcatcatgccccttatgtctagggcttcacacatgctacaatggctagtacagagggctgcgataccgcgaggtggagcgaatcccttaaagctggtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaacccttgtggagggagccgtcgaaggtgggatcggcgattgggacgaagtcgtaacaaggtagccgtaccggaaggtgcggctggatcacctcctttctaaggag

SEQ ID NO: 3325 - DNA, 1470 bp, Dinoroseobacter shibae
  ref <308>: DATABASE ACCESSION NUMBER: NCBI ACCESSION: NC_009952.1
  ref <309>: DATABASE ENTRY DATE: 2019-04-01
  ref <313>: RELEVANT RESIDUES IN SEQ ID NO: (1)..(1470)
caacttgagagtttgatcctggctcagaacgaacgctggcggcaggcttaacacatgcaagtcgagcgaagacttcggtcttagcggcggacgggtgagtaacgcgtgggaacataccctttggtacggaatagccctgggaaactgggagtaataccgtatgtggccttcgggcgaaagatttatcgccaaaggattggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgtgtgatgaaggccttagggtcgtaaagcactttcgccagggatgataatgacagtacctggtaaagaaaccccggctaactccgtgccagcagccgcggtaatacggagggggttagcgttgttcggaattactgggcgtaaagcgcgcgtaggcggaccgatcagtcagaggtgaaatcccagggctcaaccctggaactgcctttgatactgtcggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatacttgtcgcggcttccggagacggaagccttcagttcggctggacgagatacaggtgctgcatggctgtcgtcagctcgtgtcgtgagatgttcggttaagtccggcaacgagcgcaacccacacccttagttgccagcagttcggctgggcactctaggggaactgcccgtgataagcgggaggaaggtgtggatgacgtcaagtcctcatggcccttacgggttgggctacacacgtgctacaatggcagtgacaatgggttaatccccaaaagctgtctcagttcggattgtcctctgcaactcgagggcatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaa

SEQ ID NO: 3326 - DNA, 1570 bp, Dissulfuribacter thermophilus
  ref <308>: DATABASE ACCESSION NUMBER: NCBI ACCESSION: NZ_MAGO01000004.1
  ref <309>: DATABASE ENTRY DATE: 2019-04-01
  ref <313>: RELEVANT RESIDUES IN SEQ ID NO: (1)..(1570)
ttaaactggagggtttgatcctggctcagagcgaacgctggcggcgtgcctaacacatgcaagtcgtgcgagaaacctggccttcgggctggggagtacagcggcgcacgggtgagtaacgcgtaggtaacctacccctgggaccgggataacatgccgaaaggcgtgctaataccggataacatggatgagggggacctcatccatcaaaggtggcctctgcttgcaagctactacctggggatgggcctgcgtcccattagctagttggtggggtaatggcctaccaaggcaacgatgggtagcgggtctgagaggatgatccgccacactggaactggaacacggtccagactcctacgggaggcagcagtgaggaatattggacaatgggcgaaagcctgatccagcgacgccgcgtgggcgaagaaggccttcgggtcgtaaagccctgtcagaggggacgaacccctgcctggctaatatccaggtaggctgacggtaccctcagaggaagcgccggctaactccgtgccagcagccgcggtaatacggagggcgcaagcgttgctcggaatcactgggcgtaaagcgggtgtaggcggcctgtcaagtcagatgtgaaagcccacggctcaaccgtgtgaagtgcatctgaaactgacaggcttgagtgccggagagggaagtggaattcctggtgtaggggtgaaatccgtagatatcaggaggaacaccggtggcgaaggcgacttcctggacggttactgacgctgagacccgaaagcgtggggagcaaacaggattagataccctggtagtccacgccctaaacgatgggcactaggtgctgggggttttaccccctcggtgccgtagctaacgcattaagtgccccgcctggggagtacggccgcaaggttgaaactcaaaggaattgacgggggcccgcacaagcggtggagcatgtggtttaattcgaagcaacgcgaagaaccttacctgggcttgacatcccgggaaccctgtggaaacacgggggtgcctcttcggaggaacccggtgacaggtgctgcatggctgtcgtcagctcgtgtcgtgagatgttgggttaagtcccgcaacgagcgcaaccctcgcccttagttgccaccattaagttgggcactctaaggggactgccggtgtcaaaccggaggaaggtggggatgacgtcaagtcctcatggcccttatgcccagggctacacacgtgctacaatggccggtacaaagggcagccaacccgcgagggtgagcaaatcccaaaaagccggtctcagttcggatcggagtctgcaactcgactccgtgaaggtggaatcgctagtaatcccggatcagcatgccggggtgaatacgttcccgggccttgtacacaccgcccgtcacaccacgaaagctggctgtaccagaagtcgccgggctaaccccgtaaggggaggcaggcgcccaaggtatggtcagtgattggggtgaagtcgtaacaaggtagccgtaggggaacctgcggctggatcacctcctttcta

SEQ ID NO: 3327 - DNA, 1494 bp, Dolichospermum circinale
  ref <308>: DATABASE ACCESSION NUMBER: NCBI ACCESSION: NZ_APIZ01000353.1
  ref <309>: DATABASE ENTRY DATE: 2019-04-01
  ref <313>: RELEVANT RESIDUES IN SEQ ID NO: (1)..(1494)
aaaatggagagtttgatcctggctcaggatgaacgctggcggtatgcttaacacatgcaagtcgaacggtcttttaggagacagtggcggacgggtgagtaacgcgtaagaatctaccctcaggtcggggacaaccactggaaacggtggctaataccggatgtgccgagaggcgaaaggcttgctgcctggggaagagcttgcgtctgattagctagttggtagtgtaagggactaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaacagaatgacggtacctgaggaataagcatcggctaactccgtgccagcagccgcggtaatacggaggatgcaagcgttatccggaatgattgggcgtaaagagtccgtaggtggcattgaaagtctgctgttaaagagtctagctcaactagataaaagcagtggaaactacaaagctagagtttggtcggggcagaaggaattcctggtgtagcggtgaaatgcgtagatatcaggaagaacaccggtggcgaaggcgttctgctaggccgagactgacactgagggacgaaagctaggggagcgaatgggattagataccccagtagtcctagccgtaaacgatggatactaggcgtagctcgtatcgacccgagctgtgccggagctaacgcgttaagtatcccgcctggggagtacgcaggcaactgtgaaactcaaaggaattgacgggggcccgcacaagcggtggagtatgtggtttaattcgatgcaacgcgaagaaccttaccaaggcttgacatgtcacgaatcctgtagaaacataggagtgccttagggagcgtgaacacaggtggtgcatggctgtcgtcagctcgtgtcgtgagatgttgggttaagtcccgcaacgagcgcaaccctcgtttttagttgccagcattaagatgggcactctagagagactgccggtgacaaaccggaggaaggtggggatgacgtcaagtcagcatgccccttacgtcttgggctacacacgtactacaatgctacggacaaagggcagctacacagcgatgtgatgcgaatctcataaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagttggtcacgcccgaagtcgttaccccaacctattggagggggatgcctaaggtaggactgatgactggggtgaagtcgtaacaaggtagccgtaccggaaggtgtggctggatcacctccttttagggag

SEQ ID NO: 3328 - DNA, 1566 bp, Dolosicoccus paucivorans
  ref <308>: DATABASE ACCESSION NUMBER: NCBI ACCESSION: NZ_FNEL01000093.1
  ref <309>: DATABASE ENTRY DATE: 2019-04-01
  ref <313>: RELEVANT RESIDUES IN SEQ ID NO: (1)..(1566)
ttttcatgagagtttgatcctggctcaggacgaacgctggcggcatgcctaatacatgcaagtcgaacgcgactgtatcaccgccttctttgaaggcaccgatacatcgagtggcgaacgggtgagtaacacgtgggaaacctgccctttagtgggggataactgtcggaaacgaccgctaataccgcataaatcaatgattcgcatgtttcattgacaaagatgcttatggtatcgctaaaggatggtcccgcggtgcattagctagttggtaggataaaagcctaccaaggcgatgatgcgtagccgacctgagagggtgatcggccacactgggactgagacacggcccagactcctacgggaggcagcagtagggaatcatccgcaatgggcgcaagcctgacggtgcaatgccgcgtgtgtgaagaaggtcttcggatcgtaaagcactgttgtgagagaagaacagcgagtagagtaactgttactcgtttgacggtatctcaccagaaagccacggctaactacgtgccagcagccgcggtaatacgtaggtggcaagcgttgtccggatttattgggcgtaaagggagcgcaggcggtgatttaagtctgatgtgaaagcccacggctcaaccgtggaaggtcattggaaactgggtcacttgagtacagaagaggaaagcggaattccatgtgtagcggtgaaatgcgtagatatatggaggaacaccagtggcgaaggcggctttctggtctgtaactgacgctgaggctcgaaagcgtggggagcaaacaggattagataccctggtagtccacgccgtaaacgatgagtgctaagtgttggagggtttccacccttcagtgctggagttaacgcattaagcactccgcctggggagtacgaccgcaaggttgaaactcaaaggaattgacggggacccgcacaagcggtggagcatgtggtttaattcgaagcaacgcgaagaaccttaccagctcttgacatcggatgcatagcttagagataagtgaaatccttcgggacatccagacaggtggtgcatggttgtcgtcagctcgtgtcgtgagatgttgggttaagtcccgtaacgagcgcaacccctatcgtcagttgccagcattcagttggggactctggcgagactgccggtgacaaaccggaggaaggtggggatgacgtcaaatcatcatgccccttatgggctgggctacacacgtgctacaatggatggtacaacgagaagcaacgtcgcgagaccaagcggatctcttaaagccattctcagttcggattggagtctgcaactcgactccatgaagccggaatcgctagtaatcgtggatcagaacgccacggtgaatacgttcccgggtcttgtacacaccgcccgtcacaccacgagagtttgtaacacccgaagccggtggcctaacctttatggagggagccgtcgaaggtgggacagatgattggggtgaagtcgtaacaaggtagccgtatcggaaggtgcggctggatcacctcctttctaagga

SEQ ID NO: 3329 - DNA, 809 bp, Dolosigranulum pigrum
  ref <308>: DATABASE ACCESSION NUMBER: NCBI ACCESSION: NZ_NAQX01000020.1
  ref <309>: DATABASE ENTRY DATE: 2019-04-01
  ref <313>: RELEVANT RESIDUES IN SEQ ID NO: (1)..(809)
gctaccactcatggatagcctcgcggcgtattagctagttggtaaggtaatggcttaccaaggcagtgatacgtagccgacttgagagggtgatcggccacactgggactgagacacggcccagactcctacgggaggcagcagtagggaatcttccacaatgggtgcaaacctgatggagcaatgccgcgtgagtgaagaaggtcttcggatcgtaaagctctgttgttagagaagaacacgtgctaggtaactactagcgccttgacggtatctaaccagaaagtcacggctaactacgtgccagcagccgcggtaatacgtaggtgacaagcgttgtccggatttattgggcgtaaagggagcgcaggcggtctgtttagtctaatgtgaaagcccacggcttaaccgtggaacggcattggaaactgacagacttgaatgtagaagaggaaaatggaattccaagtgtagcggtggaatgcgtagatatttggaggaacaccagtggcgaaggcgattttctggtctaacattgacgctgaggctcgaaagcgtggggagcgaacaggattagataccctggtagtccacgccgtaaacgatgagtgctaagtgttgggggctttccggccctcggtgctggagctaacgtattaagcactccgcctggggattacgaccgcaaggttgaaactcaaaagaattgacggggacccgcacaagcggtggagcatgtggtttaattcgaagcaacgcgaagaaccttaccagctcttgacatcttctgacaactctagagatagagc

SEQ ID NO: 3330 - DNA, 1561 bp, Domibacillus aminovorans
  ref <308>: DATABASE ACCESSION NUMBER: NCBI ACCESSION: NZ_LQWZ01000018.1
  ref <309>: DATABASE ENTRY DATE: 2019-04-01
  ref <313>: RELEVANT RESIDUES IN SEQ ID NO: (1)..(1561)
ctttttggagagtttgatcctggctcaggacgaacgctggcggcgtgcctaatacatgcaagtcgagcggatctaaaggagcttgctcctttagattagcggcggacgggtgagtaacacgtgggcaacctgccctacagattgggataactccgggaaaccggggctaataccgaataatatcgaagatttcatgatcttcttttgaaagatggtttcggctgtcactgtaggatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacacgtacgggagtaactgtccgtaccttgacggtacctgaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggaaggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtatagagatatacttttcccttcggggacagcggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaaggaa

SEQ ID NO: 3331 - DNA, 1550 bp, Domibacillus antri
  ref <308>: DATABASE ACCESSION NUMBER: NCBI ACCESSION: NZ_MSDU01000040.1
  ref <309>: DATABASE ENTRY DATE: 2019-04-01
  ref <313>: RELEVANT RESIDUES IN SEQ ID NO: (1)..(1550)
agagtttgagcctggctcaggacgaacgctggcggggtgcctaatacatgcaagtcgagcggacttgacggagcttgctctgttcaagtcagcggcggacgggtgagtaacacgtgggcaacctgccctgcagattgggataactccgggaaaccggggctaataccgaataatagggaagatcacatgatcttcctttgaaagacggtttcggctgtcactgcaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtacgggagtaactgtccgtaccttgacggtacctggccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgcccggtatagagatatacctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 3332 - DNA, 1467 bp, Domibacillus enclensis
  ref <308>: DATABASE ACCESSION NUMBER: NCBI ACCESSION: NZ_FTLX01000023.1
  ref <309>: DATABASE ENTRY DATE: 2019-04-01
  ref <313>: RELEVANT RESIDUES IN SEQ ID NO: (1)..(1467)
tcaagttagcggcggacgggtgagtaacacgtgggcaacctgccctgcagattgggataactccgggaaaccggggctaataccgaataatatagagggtttcatgatcttcttttgaaaggcggcttcggctgtcactgcaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtatgggagtaactgcccgtaccttgacggtacctggccagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccctggagacagggcttccccttcgggggcagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 3333 - DNA, 1555 bp, Domibacillus epiphyticus
  ref <308>: DATABASE ACCESSION NUMBER: NCBI ACCESSION: NZ_MSFI01000035.1
  ref <309>: DATABASE ENTRY DATE: 2019-04-01
  ref <313>: RELEVANT RESIDUES IN SEQ ID NO: (1)..(1555)
ctttttggagagtttgatcctggctcaggacgaacgctggcggcgtgcctaatacatgcaagtcgagcggacttgacagagcttgctctgttcaagttagcggcggacgggtgagtaacacgtgggcaacctgccctgcagattgggataactccgggaaaccggggctaataccgaataatatagaagatctcatgatcttcttttgaaagacggttttgctgtcactgcaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtacgggagtaactgtccgtaccttgacggtacctggccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggagggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgcccggcatagagatatgcctttcccttcggggacagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttct

SEQ ID NO: 3334 - DNA, 267 bp, Domibacillus indicus
  ref <308>: DATABASE ACCESSION NUMBER: NCBI ACCESSION: NZ_LAJB01000025.1
  ref <309>: DATABASE ENTRY DATE: 2019-04-01
  ref <313>: RELEVANT RESIDUES IN SEQ ID NO: (1)..(267)
ctttttggagagtttgatcctggctcaggacgaacgctggcggcgtgcctaatacatgcaagtcgagcggacttgacggagcttgctccgttcaagttagcggcggacgggtgagtaacacgtgggcaacctgccctgcagattgggataactccgggaaaccggggctaataccgaataacatgggaaacctcatggtttccttttaaaaggcggcttcggctgtcactgcaggatgggcccgcggcgcattagctagttggtgag

SEQ ID NO: 3335 - DNA, 1350 bp, Domibacillus iocasae
  ref <308>: DATABASE ACCESSION NUMBER: NCBI ACCESSION: NZ_MAMP01000010.1
  ref <309>: DATABASE ENTRY DATE: 2019-04-01
  ref <313>: RELEVANT RESIDUES IN SEQ ID NO: (1)..(1350)
aaaggcggcttcggctgtcactgcaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtacgggagtaactgcccgtaccttgacggtacctggccagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgcccggtatagagatatacctttcccttcggggacagcggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 3336 - DNA, 1460 bp, Domibacillus mangrovi
  ref <308>: DATABASE ACCESSION NUMBER: NCBI ACCESSION: NZ_MRWQ01000030.1
  ref <309>: DATABASE ENTRY DATE: 2019-04-01
  ref <313>: RELEVANT RESIDUES IN SEQ ID NO: (1)..(1460)
ttagcggcggacgggtgagtaacacgtgggcaacctgccctgcagattgggataactccgggaaaccggggctaataccgaataatatcgaggatttcatgatcttcttttgaaagatggcttcggctgtcactgcaggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgtcagggaagaacacgtacgggagtaactgtccgtaccttgacggtacctgaccagaaagccacggctaactacgtgccagcagccgcggtaatacgtaggtggcaagcgttgtccggaattattgggcgtaaagcgcgcgcaggcggtcttttaagtctgatgtgaaagcccacggctcaaccgtggaaggtcattggaaactggaagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtatagagatatatctttcccttcggggacagtggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttct

SEQ ID NO: 3337 - DNA, 1113 bp, Domibacillus robiginosus
  ref <308>: DATABASE ACCESSION NUMBER: NCBI ACCESSION: NZ_LAHL01000063.1
  ref <309>: DATABASE ENTRY DATE: 2019-04-01
  ref <313>: RELEVANT RESIDUES IN SEQ ID NO: (1)..(1113)
gttgtcagggaagaacaagtacgggagtaactgcccgtaccttgacggtacctggccagaaagccacggctaactacgtgccagcagccgcggtaatacgtaggtggcaagcgttgtccggaattattgggcgtaaagcgcgcgcaggcggccttttaagtctgatgtgaaagcccacggctcaaccgtggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccggtctggagacagatcttccccttcgggggcagcggtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 3338 - DNA, 1463 bp, Domibacillus tundrae
  ref <308>: DATABASE ACCESSION NUMBER: NCBI ACCESSION: NZ_LAJA01000023.1
  ref <309>: DATABASE ENTRY DATE: 2019-04-01
  ref <313>: RELEVANT RESIDUES IN SEQ ID NO: (1)..(1463)
aagtcagcggcggacgggtgagtaacacgtgggcaacctgccctgcagattgggataactccgggaaaccggggctaataccgaataatatcgaagatttcatgatcttcttttgaaagacggtttcggctgtcactgcaggatgggcccgcggcgcattagctagttggtggggtaacggctcaccaaggccacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgtcagggaagaacaagtatgggagtaactgcccgtaccttgacggtacctggccagaaagccacggctaactacgtgccagcagccgcggtaatacgtaggtggcaagcgttgtccggaattattgggcgtaaagcgcgcgcaggcggccttttaagtctgatgtgaaagcccccggctcaaccggggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacaggattagataccctggtagtccacgccgtaaacgatgagtgctaagtgttggggggtttccgcccctcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcccgctgaccgccctggagacagggcttccccttcgggggcagcggtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaagaccgcgaggtttagccaatcccataaaaccattctcagttcggattgcaggctgcaactcgcctgcatgaagctggaatcgctagtaatcgcggatcagcatgccgcggtgaatacgttcccgggccttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttct

SEQ ID NO: 3339 - DNA, 1466 bp, Donghicola eburneus
  ref <308>: DATABASE ACCESSION NUMBER: NCBI ACCESSION: NZ_FOXY01000040.1
  ref <309>: DATABASE ENTRY DATE: 2019-04-01
  ref <313>: RELEVANT RESIDUES IN SEQ ID NO: (1)..(1466)
tcaacttgagagtttgatcctggctcagaacgaacgctggcggcaggcctaacacatgcaagtcgagcgagaccttcgggtctagcggcggacgggttagtaacgcgtgggaacgtgccctttactacggaatagtcccgggaaactgggtttaataccgtatacgcccttcgggggaaagatttatcggtaaaggatcggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggactggaaagttgggggtgaaatcccggggctcaacctcggaactgcctccaaaactactagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctaactccagagatggagtgttcccttcggggacgcagtgacaggtgctgcatggctgtcgtcagctcgtgtcgtgagatgttcggttaagtccggcaacgagcgcaacccacatccttagttgccatcattcagttgggcactctagggaaactgcccgtgataagcgggaggaaggtgtggatgacgtcaagtcctcatggcccttacgggttgggctacacacgtgctacaatggtagtgacaatgggttaatcccaaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggcggtgcgccaaccttttggaggcagccgaccacggtaagctcagcgactggggtgaagtcgtaacaaggtagccgtaggggaacctgcggctggatcacctcctttctaa

SEQ ID NO: 3340 - DNA, 1331 bp, Donghicola sp. JL3646
  ref <308>: DATABASE ACCESSION NUMBER: NCBI ACCESSION: NZ_LZFQ01000020.1
  ref <309>: DATABASE ENTRY DATE: 2019-04-01
  ref <313>: RELEVANT RESIDUES IN SEQ ID NO: (1)..(1331)
tcaacttgagagtttgatcctggctcagaacgaacgctggcggcaggcctaacacatgcaagtcgaacgggatcttcggatctagtggcggacgggttagtaacgcgtgggaacgtacccttttctacggaatagcctcgggaaactgagagtaataccgtatacgcccttcgggggaaagatttatcggagaaggatcggcccgcgtaagattagatagttggtggggtaatggcctaccaagtctacgatctttagctggtttgagaggatgatcagcaacactgggactgagacacggcccagactcctacgggaggcagcagtggggaatcttagacaatgggggaaaccctgatctagccatgccgcgtgagtgacgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggactggaaagttgggggtgaaatcccggggctcaaccccggaacggcctccaaaactatcagtctagagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcagagggcttgccctttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacctttgacatcctgtgctaacccgagagatcgggcgttcacttcggtgacgcagtgacaggtgctgcatggctgtcgtcagctcgtgtcgtgagatgttcggttaagtccggcaacgagcgcaacccacacccttagttgccagcattcagttgggcactctaggggaactgcccgtgataagcgggaggaaggtgtggatgacgtcaagtcctcatggcccttacaggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacac

SEQ ID NO: 3341 - DNA, 1465 bp, Donghicola tyrosinivorans
  ref <308>: DATABASE ACCESSION NUMBER: NCBI ACCESSION: NZ_PVTQ01000043.1
  ref <309>: DATABASE ENTRY DATE: 2019-04-01
  ref <313>: RELEVANT RESIDUES IN SEQ ID NO: (1)..(1465)
caacttgagagtttgatcctggctcagaacgaacgctggcggcaggcctaacacatgcaagtcgaacgaagtcttcggacttagtggcggacgggttagtaacgcgtgggaacgtgccctttacttcggaatagtcccgggaaactgggtttaataccgaatacgcccttcgggggaaagatttatcggtaaaggatcggcccgcgttggattaggtagttggtggggtaatggcctaccaagccgacgatccatagctggtttgagaggatgatcagcaacactgggactgagacacggcccagactcctacgggaggcagcagtggggaatcttagacaatgggggcaaccctgatctagccatgccgcgtgagtgaagaaggccttagggtcgtaaagctctttcgccagggatgataatgacagtacctggtaaagaaaccccggctaactccgtgccagcagccgcggtaatacggagggggttagcgttgttcggaattactgggcgtaaagcgcacgtaggcggacttgaaagttgggggtgaaatcccggggctcaacctcggaactgccttcaaaactccaagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgccacgtccagagatggaccgttcccttcggggacgcagtgacaggtgctgcatggctgtcgtcagctcgtgtcgtgagatgttcggttaagtccggcaacgagcgcaacccacatccttagttgccagcattcagttgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattgttctctgcaactcgagagcatgaagtcggaatcgctagtaatcgcgtaacagcatgacgcggtgaatacgttcccgggccttgtacacaccgcccgtcacaccatgggagttgggtttacccgaaggcggtgcgccaaccttttggaggcagccgaccacggtaagctcagcgactggggtgaagtcgtaacaaggtagccgtaggggaacctgcggctggatcacctcctttctaa

SEQ ID NO: 3342 - DNA, 1506 bp, Dongia sp. URHE0060
  ref <308>: DATABASE ACCESSION NUMBER: NCBI ACCESSION: NZ_JIAS01000014.1
  ref <309>: DATABASE ENTRY DATE: 2019-04-01
  ref <313>: RELEVANT RESIDUES IN SEQ ID NO: (1)..(1506)
aggttaacctgagagtttgatcctggctcagaacgaacgctggcggcatgcctaacacatgcaagtcgaacgggatccaggcttcggcctggtgagagtggcggacgggtgagtaacgcgtgggaacctgcccaatggtctgggataaccgcgggaaactgcggctaataccggataagcccgagaggggaaagatttatcgccgatggaggggcccgcgtcagattaggtagttggtggggtaatggcctaccaagcctacgatctgtagctggtctgagaggatgatcagccacactgggactgagatacggcccagactcctacgggaggcagcagtggggaatattggacaatgggggcaaccctgatccagcaatgccgcgtgagtgatgaaggccttagggttgtaaagctcttttggcggggacgatgatgacggtacccgcagaataagccccggctaacttcgtgccagcagccgcggtaatacgaagggggcgagcgttgttcggaattactgggcgtaaagggcgcgtaggcggcgacccaagtcagatgtgaaagtcctgggcttaacctggggactgcatttgatactgggttgcttgaattcgggagaggatagcggaattcccagtgtagaggtgaaattcgtagatattgggaagaacaccggtggcgaaggcggctatctggaccgacattgacgctgaggcgcgaaagcgtggggagcaaacaggattagataccctggtagtccacgccgtaaacgatgaatgctagacgctggggagcatgctcttcggtgtcgcagctaacgcattaagcattccgcctggggagtacggtcgcaagattaaaactcaaaggaattgacgggggcccgcacaagcggtggagcatgtggtttaattcgaagcaacgcgcagaaccttaccaacccttgacatgggacgtatgggcttcagagatgaggtccttcagttcggctggcgtccacacaggtgctgcatggctgtcgtcagctcgtgtcgtgagatgttgggttaagtcccgcaacgagcgcaaccctcatcttcagttgccatcatttagttgggcactctgaagaaactgccggtgacaagccggaggaaggcggggatgacgtcaagtcctcatggcccttacgggttgggctacacacgtgctacaatggcggtgacaatggggagcaaaggcgcgagcctgagccgatctcaaaaagccgtctcagttcggattgcactctgcaactcgggtgcatgaagttggaatcgctagtaatcgtggatcagcatgccacggtgaatacgttcccgggccttgtacacaccgcccgtcacaccatgggagttggttctacccgaagccggtgcgctaaccgcaaggaagcagccgaccacggtagggtcagcgactggggtgaagtcgtaacaaggtagccgtaggggaacctgcggctggatcacctcctttctaagg

SEQ ID NO: 3343 - DNA, 1540 bp, Dorea longicatena
  ref <308>: DATABASE ACCESSION NUMBER: NCBI ACCESSION: NZ_QRHW01000069.1
  ref <309>: DATABASE ENTRY DATE: 2019-04-01
  ref <313>: RELEVANT RESIDUES IN SEQ ID NO: (1)..(1540)
tttaacgagagtttgatcctggctcaggatgaacgctggcggcgtgcttaacacatgcaagtcgagcgaagcacttaagtttgattcttcggatgaagacttttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccgacctgagagggtgaccggccacattgggactgagacacggcccagactcctacgggaggcagcagtggggaatattgcacaatggaggaaactctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcacggcaagccagatgtgaaagcccggggctcaaccccgggactgcatttggaactgctgagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactgctaggtgtcgggtggcaaagccattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccctatcttcagtagccagcaggttaagctgggcactctggagagactgccagggataacctggaggaaggtggggatgacgtcaaatcatcatgccccttatgaccagggctacacacgtgctacaatggcgtaaacaaagagaagcgaactcgcgagggtaagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 3344 - DNA, 1538 bp, Dorea sp. 5-2
  ref <308>: DATABASE ACCESSION NUMBER: NCBI ACCESSION: NZ_KE159737.1
  ref <309>: DATABASE ENTRY DATE: 2019-04-01
  ref <313>: RELEVANT RESIDUES IN SEQ ID NO: (1)..(1538)
tttagacgagagtttgatcctggctcaggatgaacgctggcggcgtgcctaacacatgcaagtcgagcgaagcacttaaaatggattcttcggatgaagctttatgtgactgagcggcggacgggtgagtaacgcgtgggcaacctgccttacacagggggataacagttagaaatgactgctaataccgcataagaccacagggctgcatggcctggtggtaaaaactccggtggtgtaagatgggcccgcgtctgattaggtagttggcggggtaacggcccaccaagccgacgatcagtagccgacctgagagggtgaccggccacattgggactgagacacggcccagactcctacgggaggcagcagtggggaatattgcacaatgggggaaaccctgatgcagcgacgccgcgtgagcgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcggcgcaagccagatgtgaaagcccggggctcaaccccgggactgcatttggaactgtgctgctagagtgtcggagaggcaggcggaattcctagtgtagcggtgaaatgcgtagatattaggaggaacaccagtggcgaaggcggcctgctggacgatgactgacgttgaggctcgaaagcgtggggagcaaacaggattagataccctggtagtccacgccgtaaacgatgactactaggtgtcgggcagcaaagctgttcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctggccttgacatccccctgactggctcgtaatggggcctttccttcgggacaggggagacaggtggtgcatggttgtcgtcagctcgtgtcgtgagatgttgggttaagtcccgcaacgagcgcaacccctatcttcagtagccagcattacggatgggcactctggagagactgccagggacaacctggaggaaggtggggatgacgtcaaatcatcatgccccttatggccagggctacacacgtgctacaatggcgtaaacaaagggaagcagccatgtgaatgtgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagccggtgacctaaccgaaagggaggagccgtcgaaggtgggaccgataactggggtgaagtcgtaacaaggtagccgtatcggaaggtgcggctggatcacctcctttctaagg

SEQ ID NO: 3345 - DNA, 1539 bp, Dorea sp. AF24-7LB
  ref <308>: DATABASE ACCESSION NUMBER: NCBI ACCESSION: NZ_QUFR01000028.1
  ref <309>: DATABASE ENTRY DATE: 2019-04-01
  ref <313>: RELEVANT RESIDUES IN SEQ ID NO: (1)..(1539)
tttaacgagagtttgatcctggctcaggatgaacgctggcggcgtgcttaacacatgcaagtcgagcgaagcacctaagaaagattcttcggatgaattcttttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcattgcaagccagatgtgaaagcccggggctcaaccccgggactgcatttggaactgtagagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcgggtagcaaagctattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcctgatgaccgctccgtaatgggagtttttcttcggaacatcagagacaggtggtgcatggttgtcgtcagctcgtgtcgtgagatgttgggttaagtcccgcaacgagcgcaacccctatcttcagtagccagcattcaggatgggcactctggagagactgccagggataacctggaggaaggtggggatgacgtcaaatcatcatgccccttatgaccagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacctaaccgtaaggaaggagctgccgaaggtgggaccgataactggggtgaagtcgtaacaaggtagccgtatcggaaggtgcggctggatcacctcctttctaaggaa

SEQ ID NO: 3346 - DNA, 1538 bp, Dorea sp. AF36-15AT
  ref <308>: DATABASE ACCESSION NUMBER: NCBI ACCESSION: NZ_QUDV01000007.1
  ref <309>: DATABASE ENTRY DATE: 2019-04-01
  ref <313>: RELEVANT RESIDUES IN SEQ ID NO: (1)..(1538)
tttttacgagagtttgatcctggctcaggatgaacgctggcggcgtgcttaacacatgcaagtcgaacgaagcacttaagtttgattcttcggatgaagacttttgtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggtatggcaagtctgatgtgaaaggccagggctcaaccctgggactgcattggaaactgtcgaactagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcgggtagcagagctattcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggtatggccgggcactctagagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggtgggaccgataactggggtgaagtcgtaacaaggtagccgtatcggaaggtgcggctggatcacctcctttctaagg

SEQ ID NO: 3347 - DNA, 1539 bp, Dorea sp. AM10-31; identical to SEQ ID NO: 3345
  ref <308>: DATABASE ACCESSION NUMBER: NCBI ACCESSION: NZ_QTUV01000005.1
  ref <309>: DATABASE ENTRY DATE: 2019-04-01
  ref <313>: RELEVANT RESIDUES IN SEQ ID NO: (1)..(1539)

SEQ ID NO: 3348 - DNA, 1538 bp, Dorea sp. AM13-35
  ref <308>: DATABASE ACCESSION NUMBER: NCBI ACCESSION: NZ_QUCZ01000004.1
  ref <309>: DATABASE ENTRY DATE: 2019-04-01
  ref <313>: RELEVANT RESIDUES IN SEQ ID NO: (1)..(1538)
tttaacgagagtttgatcctggctcaggatgaacgctggcggcgtgcttaacacatgcaagtcgagcgaagcacctaagaaagattcttcggatgaattcttttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcattgcaagccagatgtgaaagcccggggctcaaccccgggactgcatttggaactgtagagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcgggtagcaaagctattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcctgatgaccgctccgtaatgggagtttttcttcggaacatcagagacaggtggtgcatggttgtcgtcagctcgtgtcgtgagatgttgggttaagtcccgcaacgagcgcaacccctatcttcagtagccagcattcaggatgggcactctggagagactgccagggataacctggaggaaggtggggatgacgtcaaatcatcatgccccttatgaccagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacctaaccgtaaggaaggagctgccgaaggtgggaccgataactggggtgaagtcgtaacaaggtagccgtatcggaaggtgcggctggatcacctcctttctaagga

SEQ ID NO: 3349 - DNA, 1539 bp, Dorea sp. AM58-8
  ref <308>: DATABASE ACCESSION NUMBER: NCBI ACCESSION: NZ_QSDM01000042.1
  ref <309>: DATABASE ENTRY DATE: 2019-04-01
  ref <313>: RELEVANT RESIDUES IN SEQ ID NO: (1)..(1539)
tttttacgagagtttgatcctggctcaggatgaacgctggcggcgtgcttaacacatgcaagtcgaacgaagcacttaagtttgattcttcggatgaagacttttgtgactgagtggcggacgggtgagtaacgcgtgggtaacctgcctcatacagggggataacagttagaaatgactgctaataccgcataagaccacagcaccgcatggtgcaggggtaaaaactccggtggtatgagatggacccgcgtctgattagctggttggtggggtaacggcctaccaagcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggtatggcaagtctgatgtgaaaggccagggctcaaccctgggactgcattggaaactgtcgaactagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcgggtagcagagctattcggtgccgcagccaacgcaataagtagtccacctggggagtacgttcgcaagaatgaaactcaaaggaattgacggggacccgcacaagcggtggagcatgtggtttaattcgaagcaacgcgaagaaccttacctgctcttgacatctccctgaccggcaagtaatgttgcctttccttcgggacagggatgacaggtggtgcatggttgtcgtcagctcgtgtcgtgagatgttgggttaagtcccgcaacgagcgcaacccctatctttagtagccagcggttcggccgggcactctagagagactgccagggataacctggaggaaggtggggatgacgtcaaatcatcatgccccttatgagcagggctacacacgtgctacaatggcgtaaacaaagggaagcgagcctgcgagggtaagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgcaaggagggagctgccgaaggtgggaccgataactggggtgaagtcgtaacaaggtagccgtatcggaaggtgcggctggatcacctcctttctaaggaa

SEQ ID NO: 3350 - DNA, 1545 bp, Dorea sp. D27
  ref <308>: DATABASE ACCESSION NUMBER: NCBI ACCESSION: NZ_KQ236749.1
  ref <309>: DATABASE ENTRY DATE: 2019-04-01
  ref <313>: RELEVANT RESIDUES IN SEQ ID NO: (1)..(1545)
ttttaagacgagagtttgatcctggctcaggatgaacgctggcggcgtgcttaacacatgcaagtcgagcgaagcgctctgttcagatttcttcggaatgaagagcattgcgactgagcggcggacgggtgagtaacgcgtgggcaacctgcctcacacagggggataacagctagaaatggctgctaataccgcataaggctacagagccgcatggctcggtggcaaaagctccggcggtgtgagatgggcccgcgtctgattaggtagttggtggggcagaggcccaccaagccgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaagatgacggtacctgactaagaagccccggctaactacgtgccagcagccgcggtaatacgtagggggcaagcgttatccggatttactgggtgtaaagggagcgtagacggcatggcaagtctggagtgaaagcccggggctcaaccccgggactgctttggaaactgccatgctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgattactaggtgtcgggaagcaaagcttctcggtgccgcagccaacgcaataagtaatccacctggggagtacgttcgcaagaatgaaactcaaaggaattgacggggacccgcacaagcggtggagcatgtggtttaattcgaagcaacgcgaagaaccttacctggtcttgacatcccaatggccggcacgtaacggtgcctttccttcgggacattggtgacaggtggtgcatggttgtcgtcagctcgtgtcgtgagatgttgggttaagtcccgcaacgagcgcaacccctatctttagtagccagcaggcaaggctgggcactctagagagactgccagggataacctggaggaaggtggggatgacgtcaaatcatcatgccccttatgaccagggctacacacgtgctacaatggcgtaaacaaagggaggcgaccccgcgagggcaagcgaatcccaaaaataacgtcccagttcggattgtagtctgcaacccgactacatgaagctggaatcgctagtaatcgcgaatcagaatgtcgcggtgaatacgttcccgggtcttgtacacaccgcccgtcacaccatgggagtcggtaacgcccgaagtcagtgacccaaccgcaaggagggagctgccgaaggtgggaccgataactggggtgaagtcgtaacaaggtagccgtatcggaaggtgcggctggatcacctcctttctaaggaa

SEQ ID NO: 3351 - DNA, 1540 bp, Dorea sp. Marseille-P4003
  ref <308>: DATABASE ACCESSION NUMBER: NCBI ACCESSION: NZ_OEPZ01000011.1
  ref <309>: DATABASE ENTRY DATE: 2019-04-01
  ref <313>: RELEVANT RESIDUES IN SEQ ID NO: (1)..(1540)
tttaacgagagtttgatcctggctcaggatgaacgctggcggcgtgcttaacacatgcaagtcgagcgaagcgcttaagtttgattcttcggatgaagacttttgtgactgagcggcggacgggtgagtaacgcgtgggtaacctgcctcatacagggggataacagttagaaatgactgctaataccgcataagaccacaaggtcgcatgaccaggtggtaaaaactccggtggtatgagatggacccgcgtctgattaggtagttggtgaggtaacggctcaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaataagacggtacctgactaagaagccccggctaactacgtgccagcagccgcggtaatacgtagggggcaagcgttatccggatttactgggtgtaaagggagcgtagacggctgtgcaagtctgaagtgaaagcccggggctcaaccccgggactgctttggaaactgtatagctagagtgctggagaggtaagtggaattcctagtgtagcggtgaaatgcgtagatattaggaggaacaccagtggcgaaggcggcttactggacagtgactgacgttgaggctcgaaagcgtggggagcaaacaggattagataccctggtagtccacgccgtaaacgatgactactaggtgtcgggtgacaaagtcattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcccgctgaccgttccgtaatgggaactttccttcgggacagcggtgacaggtggtgcatggttgtcgtcagctcgtgtcgtgagatgttgggttaagtcccgcaacgagcgcaacccctatctttagtagccagcatttcggatgggcactctagagagactgccagggataacctggaggaaggtggggatgacgtcaaatcatcatgccccttatgaccagggctacacacgtgctacaatggcgtaaacaaagggaagcaaagctgtgaggccgagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacccaaccgtaaggagggagctgccgaaggtgggaccgataactggggtgaagtcgtaacaaggtagccgtatcggaaggtgcggctggatcacctcctttctaaggaa

SEQ ID NO: 3352 - DNA, 1539 bp, Dorea sp. Marseille-P4042
  ref <308>: DATABASE ACCESSION NUMBER: NCBI ACCESSION: NZ_OLMI01000003.1
  ref <309>: DATABASE ENTRY DATE: 2019-04-01
  ref <313>: RELEVANT RESIDUES IN SEQ ID NO: (1)..(1539)
ttaaacgagagtttgatcctggctcaggatgaacgctggcggcgtgcttaacacatgcaagtcgagcgaagcacttaagttcgattcttcggatgaagacttttgtgactgagcggcggacgggtgagtaacgcgtgggtaacctgcctcatacagggggataacagttagaaatggctgctaataccgcataagaccacagtactgcatggtacagtggtaaaaactccggtggtatgagatggacccgcgtctgattaggtagttggtgaggtaacggcccaccaagccgacgatcagtagccgacctgagagggtgaccggccacattgggactgagacacggcccagactcctacgggaggcagcagtggggaatattgcacaatgggcgaaagcctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggctgtgcaagtctgaagtgaaaggcatgggctcaacctgtggactgctttggaaactgtgcagctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactgctaggtgtcgggtagcaaagctattcggtgccgcagctaacgcaataagcagtccacctggggagtacgttcgcaagaatgaaactcaaaggaattgacggggacccgcacaagcggtggagcatgtggtttaattcgaagcaacgcgaagaaccttacctgatcttgacatcccgatgaccgcttcgtaatggaagcttttcttcggaacatcggtgacaggtggtgcatggttgtcgtcagctcgtgtcgtgagatgttgggttaagtcccgcaacgagcgcaacccttatcttcagtagccagcatttagggtgggcactctggagagactgccagggataacctggaggaaggtggggatgacgtcaaatcatcatgccccttatgaccagggctacacacgtgctacaatggcgtaaacaaagggaagcagagccgcgaggccgagcaaatctcaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagtcagtaacgcccgaagtcagtgacccaaccgaaaggagggagctgccgaaggtgggaccgataactggggtgaagtcgtaacaaggtagccgtatcggaaggtgcggctggatcacctcctttctaaggaa

SEQ ID NO: 3353 - DNA, 1540 bp, Dorea sp. OM02-2LB
  ref <308>: DATABASE ACCESSION NUMBER: NCBI ACCESSION: NZ_QSVK01000003.1
  ref <309>: DATABASE ENTRY DATE: 2019-04-01
  ref <313>: RELEVANT RESIDUES IN SEQ ID NO: (1)..(1540)
tttaacgagagtttgatcctggctcaggatgaacgctggcggcgtgcttaacacatgcaagtcgaacgaagcacttgatcggattttcttcggagatgaagatcctgtgactgagtggcggacgggtgagtaacgcgtgggcaacctgccttgtacagggggataacagttagaaatgactgctaataccgcataagaccacagcaccacatggtgcaggggtaaaaactgaggtggtacaagatgggcccgcgtctgattagctggttggtgaggtaacggctcaccaaggcgacgatcagtagccgacctgagagggtgaccggccacattgggactgagacacggcccaaactcctacgggaggcagcagtggggaatattgcacaatgggggaaaccctgatgcagcgacgccgcgtgagtgatgaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggaacagcaagtctgatgtgaaaacccggggctcaaccccgggactgcattggaaactgttgatctagagtgtcggagaggtaagtggaattcctagtgtagcggtgaaatgcgtagatattaggaggaacaccagtggcgaaggcggcttactggacgatgactgacgttgaggctcgaaagcgtggggagcaaacaggattagataccctggtagtccacgccgtaaacgatgactactaggtgtcgggtggcaaagccattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgcccttgacatccgaatgaccggtgagtaatgtcgcctttccttcgggacattcgagacaggtggtgcatggttgtcgtcagctcgtgtcgtgagatgttgggttaagtcccgcaacgagcgcaacccttatctttagtagccagcaattaggatgggcactctagagagactgccagggataacctggaggaaggtggggatgacgtcaaatcatcatgccccttatgggcagggctacacacgtgctacaatggcgtaaacaaagggaagcagagtcgtgaggccgagcaaatctcaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagttggtaacgcccgaagtcagtgacccaaccgtaaggagggagctgccgaaggtgggaccgataactggggtgaagtcgtaacaaggtagccgtatcggaaggtgcggctggatcacctcctttctaagga

SEQ ID NO: 3354 - DNA, 1510 bp, Dorea sp. OM07-5
  ref <308>: DATABASE ACCESSION NUMBER: NCBI ACCESSION: NZ_QUKZ01000001.1
  ref <309>: DATABASE ENTRY DATE: 2019-04-01
  ref <313>: RELEVANT RESIDUES IN SEQ ID NO: (1)..(1510)
tttaacgagagtttgatcctggctcaggatgaacgctggcggcgtgcttaacacatgcaagtcgagcgaagcacctaagaaagattcttcggatgaattcttttgtgactgagcggcggacgggtgagtaacgcgtgggtaacctgcctcatacagggggataacagttagaaatgactgctaataccgcataagaccacggtactgcatggtacagtggtaaaaactccggtggtatgagatggacccgcgtctgattagctagttggtggggtaacggcctaccaaggcgacgatcagtagccgacctgagagggtgaccggccacattgggactgagacacggcccaaactcctacgggaggcagcagtggggaatattgcacaatgggggaaaccctgatgcagcgacgccgcgtgaaggatgaagtatttcggtatgtaaacttctatcagcagggaagaaaatgacggtacctgactaagaagccccggctaactacgtgccagcagccgcggtaatacgtagggggcaagcgttatccggatttactgggtgtaaagggagcgtagacggcattgcaagccagatgtgaaagcccggggctcaaccccgggactgcatttggaactgtagagctagagtgtcggagaggcaagtggaattcctagtgtagcggtgaaatgcgtagatattaggaggaacaccagtggcgaaggcggcttgctggacgatgactgacgttgaggctcgaaagcgtggggagcaaacaggattagataccctggtagtccacgccgtaaacgatgactactaggtgtcgggtagcaaagctattcggtgccgcagcaaacgcaataagtagtccacctggggagtacgttcgcaagaatgaaactcaaaggaattgacggggacccgcacaagcggtggagcatgtggtttaattcgaagcaacgcgaagaaccttacctgatcttgacatcctgatgaccgctccgtaatgggagtttttcttcggaacatcagagacaggtggtgcatggttgtcgtcagctcgtgtcgtgagatgttgggttaagtcccgcaacgagcgcaacccctatcttcagtagccagcattaaggatgggcactctggagagactgccagggataacctggaggaaggtggggatgacgtcaaatcatcatgccccttatgaccagggctacacacgtgctacaatggcgtaaacaaagggaagcgagaccgcgaggtggagcaaatcccaaaaataacgtctcagttcggattgtagtctgcaactcgactacatgaagctggaatcgctagtaatcgcgaatcagaatgtcgcggtgaatacgttcccgggtcttgtacacaccgcccgtcacaccatgggagtcagtaacgcccgaagtcagtgacctaaccgtaaggaaggagctgccgaaggtgggaccgataactggggtgaagtcgtaacaaggtagccgtatcggaagg

SEQ ID NO: 3355 - DNA, 595 bp, Duganella sp. BJB475
  ref <308>: DATABASE ACCESSION NUMBER: NCBI ACCESSION: NZ_QVIP01000038.1
  ref <309>: DATABASE ENTRY DATE: 2019-04-01
  ref <313>: RELEVANT RESIDUES IN SEQ ID NO: (1)..(595)
agattaaactgaagagtttgatcctggctcagattgaacgctggcggcatgccttacacatgcaagtcgaacggcagcgcggggcaacctggcggcgagtggcgaacgggtgagtaatatatcggaacgtaccctggagtgggggataacgtagcgaaagttacgctaataccgcatacgatctaaggatgaaagtgggggatcgcaagacctcatgctcctggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaacggcctgttctaatacagtgggctaatgacggtacctgaagaataagcaccggctaactacgtgccagcagccgcggtaatacgtagggtgcaagcgttaatcggaattactgggcgtaaagcgtgcgcaggcggttttgtaagt

SEQ ID NO: 3356 - DNA, 595 bp, Duganella sp. BJB476; identical to SEQ ID NO: 3355
  ref <308>: DATABASE ACCESSION NUMBER: NCBI ACCESSION: NZ_QVIO01000035.1
  ref <309>: DATABASE ENTRY DATE: 2019-04-01
  ref <313>: RELEVANT RESIDUES IN SEQ ID NO: (1)..(595)

SEQ ID NO: 3357 - DNA, 972 bp, Duganella sp. BJB480
  ref <308>: DATABASE ACCESSION NUMBER: NCBI ACCESSION: NZ_QVIN01000031.1
  ref <309>: DATABASE ENTRY DATE: 2019-04-01
  ref <313>: RELEVANT RESIDUES IN SEQ ID NO: (1)..(972)
tgctaatgacggtacctgaagaataagcaccggctaactacgtgccagcagccgcggtaatacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggctggaatccccgagagattggggagtgctcgaaagagaaccagtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccg

SEQ ID NO: 3358 - DNA, 972 bp, Duganella sp. BJB488; identical to SEQ ID NO: 3357
  ref <308>: DATABASE ACCESSION NUMBER: NCBI ACCESSION: NZ_QVIM01000036.1
  ref <309>: DATABASE ENTRY DATE: 2019-04-01
  ref <313>: RELEVANT RESIDUES IN SEQ ID NO: (1)..(972)

SEQ ID NO: 3359 - DNA, 972 bp, Duganella sp. BJB489; identical to SEQ ID NO: 3357
  ref <308>: DATABASE ACCESSION NUMBER: NCBI ACCESSION: NZ_QVIL01000040.1
  ref <309>: DATABASE ENTRY DATE: 2019-04-01
  ref <313>: RELEVANT RESIDUES IN SEQ ID NO: (1)..(972)

SEQ ID NO: 3360 - DNA, 1541 bp, Duganella sp. CF458
  ref <308>: DATABASE ACCESSION NUMBER: NCBI ACCESSION: NZ_FOOF01000043.1
  ref <309>: DATABASE ENTRY DATE: 2019-04-01
  ref <313>: RELEVANT RESIDUES IN SEQ ID NO: (1)..(1541)
agagattgaactgaagagtttgatcctggctcagattgaacgctggcggcatgctttacacatgcaagtcgaacggcagcgcgggcttcggcctggcggcgagtggcgaacgggtgagtaatatatcggaacgtacccaagagtgggggataacgtagcgaaagttacgctaataccgcatacgatctaaggatgaaagcaggggatcgcaagaccttgtgctcctggagcggccgatatctgattagctagttggtggggtaaaggcccaccaaggcaacgatcagtagctggtctgagaggacgaccagccacactggaactgagacacggtccagactcctacgggaggcagcagtggggaattttggacaatgggggcaaccctgatccagcaatgccgcgtgagtgaagaaggccttcgggttgtaaagctcttttgtcagggaagaaaaggctgtggctaatatccacagctgctgacggtacctgaagaataagcaccggctaactacgtgccagcagccgcggtaatacgtagggtgcaagcgttaatcggaattactgggcgtaaagcgtgcgcaggcggtttcgtaagtctgtcgtgaaatccccgggcttaacctgggaatggcgatggagactgcgaggctagagtttggcagaggggggtagaattccacgtgtagcagtgaaatgcgtagagatgtggaggaacaccgatggcgaaggcagccccctgggtcaaaactgacgctcatgcacgaaagcgtggggagcaaacaggattagataccctggtagtccacgccctaaacgatgtctactagttgttgggtcttaattgacttagtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggcaggaatcccgaagagatttgggagtgctcgaaagagaacctgcacacaggtgctgcatggctgtcgtcagctcgtgtcgtgagatgttgggttaagtcccgcaacgagcgcaacccttgtcattagttgctacgcaagagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggttttaccagaagtaggtagcttaaccgtaaggagggcgcttaccacggtaggattcgtgactggggtgaagtcgtaacaaggtagccgtatcggaaggtgcggctggatcacctcctttcta

SEQ ID NO: 3361 - DNA, 1538 bp, Duganella sp. GV023
  ref <308>: DATABASE ACCESSION NUMBER: NCBI ACCESSION: NZ_QREC01000017.1
  ref <309>: DATABASE ENTRY DATE: 2019-04-01
  ref <313>: RELEVANT RESIDUES IN SEQ ID NO: (1)..(1538)
attaaactaaagagtttgatcctggctcagattgaacgctggcggcatgccttacacatgcaagtcgaacggcagcacggagcttgctctggtggcgagtggcgaacgggtgagtaatatatcggaacgtaccctggagtgggggataacgtagcgaaagttacgctaataccgcatacgatctaaggatgaaagtgggggctcgcaagacctcatgctcctggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaaagggtctggctaatatctaggcctcatgacggtacctgaagaataagcaccggctaactacgtgccagcagccgcggtaatacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatccctgagagattggagagtgcccgaaagggaaccattacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 3362 - DNA, 1540 bp, Duganella sp. GV032
  ref <308>: DATABASE ACCESSION NUMBER: NCBI ACCESSION: NZ_QUNB01000017.1
  ref <309>: DATABASE ENTRY DATE: 2019-04-01
  ref <313>: RELEVANT RESIDUES IN SEQ ID NO: (1)..(1540)
agattaaactaaagagtttgatcctggctcagattgaacgctggcggcatgccttacacatgcaagtcgaacggcagcacggagcttgctctggtggcgagtggcgaacgggtgagtaatatatcggaacgtaccctggagtgggggataacgtagcgaaagttacgctaataccgcatacgatctaaggatgaaagtgggggctcgcaagacctcatgctcctggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaaagggtctggctaatatctaggcctcatgacggtacctgaagaataagcaccggctaactacgtgccagcagccgcggtaatacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcttcgagagattgaggagtgcccgaaagggaaccattacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 3363 - DNA, 1538 bp, Duganella sp. GV038
  ref <308>: DATABASE ACCESSION NUMBER: NCBI ACCESSION: NZ_QUNP01000017.1
  ref <309>: DATABASE ENTRY DATE: 2019-04-01
  ref <313>: RELEVANT RESIDUES IN SEQ ID NO: (1)..(1538)
attaaactaaagagtttgatcctggctcagattgaacgctggcggcatgccttacacatgcaagtcgaacggcagcacggagcttgctctggtggcgagtggcgaacgggtgagtaatatatcggaacgtaccctggagtgggggataacgtagcgaaagttacgctaataccgcatacgatctaaggatgaaagtgggggctcgcaagacctcatgctcctggagcggccgatatctgattagctagttggtagggtaaaagcctaccaaggcatcgatcagtagctggtctgagaggacgaccagccacactggaactgagacacggtccagactcctacgggaggcagcagtggggaattttggacaatgggcgcaagcctgatccagcaatgccgcgtgagtgaagaaggccttcgggttgtaaagctcttttgtcagggaagaaaagggtctggctaatatctaggcctcatgacggtacctgaagaataagcaccggctaactacgtgccagcagccgcggtaatacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatctccgagagattggagagtgcccgaaagggaaccattacacaggtgctgcatggctgtcgtcagctcgtgtcgtgagatgttgggttaagtcccgcaacgagcgcaacccttgtcattagttgctacgaaagagcactctaatgagactgccggtgacaaaccggaggaaggtggggatgacgtcaagtcctcatggcccttatgggtagggcttcacacgtcatacaatggtacatacagagcgccgccaacccgcgagggggagctaatcgcagaaagtgtatcgtagtccggattgtagtctgcaactcgactgcatgaagttggaatcgctagtaatcgcggatcagcatgtcgcggtgaatacgttcccgggtcttgtacacaccgcccgtcacaccatgggagcgggttttaccagaagtaggtagcttaaccgcaaggagggcgcttaccacggtaggattcgtgactggggtgaagtcgtaacaaggtagccgtatcggaaggtgcggctggatcacctcctttctag

SEQ ID NO: 3364 - DNA, 1540 bp, Duganella sp. GV046; identical to SEQ ID NO: 3362
  ref <308>: DATABASE ACCESSION NUMBER: NCBI ACCESSION: NZ_QUND01000017.1
  ref <309>: DATABASE ENTRY DATE: 2019-04-01
  ref <313>: RELEVANT RESIDUES IN SEQ ID NO: (1)..(1540)

SEQ ID NO: 3365 - DNA, 1540 bp, Duganella sp. GV067; identical to SEQ ID NO: 3362
  ref <308>: DATABASE ACCESSION NUMBER: NCBI ACCESSION: NZ_QUNU01000019.1
  ref <309>: DATABASE ENTRY DATE: 2019-04-01
  ref <313>: RELEVANT RESIDUES IN SEQ ID NO: (1)..(1540)

SEQ ID NO: 3366 - DNA, 1540 bp, Duganella sp. GV089; identical to SEQ ID NO: 3362
  ref <308>: DATABASE ACCESSION NUMBER: NCBI ACCESSION: NZ_RCWV01000017.1
  ref <309>: DATABASE ENTRY DATE: 2019-04-01
  ref <313>: RELEVANT RESIDUES IN SEQ ID NO: (1)..(1540)

SEQ ID NO: 3367 - DNA, 338 bp, Dyadobacter alkalitolerans
  ref <308>: DATABASE ACCESSION NUMBER: NCBI ACCESSION: NZ_AUAS01000028.1
  ref <309>: DATABASE ENTRY DATE: 2019-04-01
  ref <313>: RELEVANT RESIDUES IN SEQ ID NO: (1)..(338)
tttacaatggagagtttgatcctggctcaggatgaacgctagcggcaggcttaatacatgcaaggcgagggggcagcaatgtcaccgtcgtacgggtgcgtaacgcgtatgcaacctaccttcaactgggggatagcccggggaaacccggattaataccgcataacacatttatatcacctgatatttattgttaaagatttattggttgaagatgggcatgcgttcgattagctagttggtgcaggtaacggctcaccaaggcgacgatcgataggggagctgagaggttgatcccccacacgggcactgagatacgggcccgactcctacgggag

SEQ ID NO: 3368 - DNA, 1516 bp, Dyadobacter beijingensis
  ref <308>: DATABASE ACCESSION NUMBER: NCBI ACCESSION: NZ_KB907799.1
  ref <309>: DATABASE ENTRY DATE: 2019-04-01
  ref <313>: RELEVANT RESIDUES IN SEQ ID NO: (1)..(1516)
tttacaatggagagtttgatcctggctcaggatgaacgctagcggcaggcttaatacatgcaaggcgaaggggcagcaatgtcactgtcgtacgggtgcgtaacgcgtatgcaacctacctatcactgggggatagcccggggaaacccggattaataccgcataaaacaggggcaccgcatggtgatatttgttaaagatttattggtgatagatgggcatgcgttcgattagctagttggcggggtaacggcccaccaaggcgacgatcgataggggagctgagaggttgatcccccacacgggcactgagatacgggcccgactcctacgggaggcagcagtagggaatattgggcaatggatgcaagtctgacccagccatgccgcgtgccggatgaaggccctcagggttgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgatttgtttgacactgaggcacgaaagcatggggagcaaacaggattagataccctggtagtccatgctgtaaacgatgaggactcgttgtttggctgcaaggctgagcgacttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcagagaggaattatgcagaaatgtgtaagctagcaatagtctctttgaaggtgctgcatggctgtcgtcagctcgtgtcgtgagatgttgggttaagtcccgcaacgagcgcaacccctatggttagttgccagcacgtaatggtggggactctagccagactgcctgtgcaaacagagaggaaggaggggacgacgtcaagtcatcatggcccttacgtccagggcaacacacgtgctacaatggatggtacagagggtagctacacggcgacgtgatgccaatcccaaaaagccattctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcggtaggttaaagacaccgttagggtaaaatcggcgactggggctaagtcgtaacaaggtagccgtaccggaaggtgcggctggaacacctcctttctggag

SEQ ID NO: 3369 - DNA, 262 bp, Dyadobacter crusticola
  ref <308>: DATABASE ACCESSION NUMBER: NCBI ACCESSION: NZ_JNJB01000020.1
  ref <309>: DATABASE ENTRY DATE: 2019-04-01
  ref <313>: RELEVANT RESIDUES IN SEQ ID NO: (1)..(262)
tttacaatggagagtttgatcctggctcaggatgaacgctagcggcaggcttaatacatgcaaggcgaaggggcagcaatgtcactgtcgtacgggtgcgtaacgcgtatgcaacctaccttttactgggggatagcccggggaaacccggattaataccgcatactacattaaggccacctggtttaaatgtgaaagatttattggtaaaagatgggcatgcgttcgattagctagttggcagggtaacggcctaccaagg

SEQ ID NO: 3370 - DNA, 1516 bp, Dyadobacter fermentans
  ref <308>: DATABASE ACCESSION NUMBER: NCBI ACCESSION: NC_013037.1
  ref <309>: DATABASE ENTRY DATE: 2019-04-01
  ref <313>: RELEVANT RESIDUES IN SEQ ID NO: (1)..(1516)
tttacaatggagagtttgatcctggctcaggatgaacgctagcggcaggcttaatacatgcaaggcgaaggggcagcaatgtcactgtcgtacgggtgcgtaacgcgtatgcaacctacctatcactgggggatagcccggggaaacccggattaataccgcataaaacaggggcaccgcatggtgatatttgttaaagatttattggtgatagatgggcatgcgttcgattagctagttggcggggtaacggcccaccaaggcgacgatcgataggggagctgagaggttgatcccccacacgggcactgagatacgggcccgactcctacgggaggcagcagtagggaatattgggcaatggatgcaagtctgacccagccatgccgcgtgccggatgaaggccctcagggttgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggccttataagtcagtggtgaaatacggttgctcaacaatcgaggtgccattgatactgtgaggcttgaaataattggaggctgccggaatggatggtgtagcggtgaaatgcatagatatcatccagaacaccgattgcgaaggcaggtggctacgatttgtttgacactgaggcacgaaagcatggggagcaaacaggattagataccctggtagtccatgctgtaaacgatgaggactcgttgtttgacggtaacgttgagcgacttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcagacaggaattatgcagaaatgtgtaagccagcaatggcctgtttgaaggtgctgcatggctgtcgtcagctcgtgtcgtgagatgttgggttaagtcccgcaacgagcgcaacccctatggttagttgccagcacgtaatggtggggactctagccagactgcctgtgcaaacagagaggaaggaggggacgacgtcaagtcatcatggcccttacgtccagggcaacacacgtgctacaatgggcggtacagagggttgctacacagcgatgtgatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcggtaggttaaagacaccgttagggtaaaatcggcgactggggctaagtcgtaacaaggtagccgtaccggaaggtgcggctggaacacctcctttctggag

SEQ ID NO: 3371 - DNA, 1516 bp, Dyadobacter jiangsuensis
  ref <308>: DATABASE ACCESSION NUMBER: NCBI ACCESSION: NZ_PYAS01000038.1
  ref <309>: DATABASE ENTRY DATE: 2019-04-01
  ref <313>: RELEVANT RESIDUES IN SEQ ID NO: (1)..(1516)
tttacaatggagagtttgatcctggctcaggatgaacgctagcggcaggcttaatacatgcaaggcgaaggggcagcaatgtcactgtcgtacgggtgcgtaacgcgtatgcaacctacctatcactgggggatagcccggggaaacccggattaataccgcataaaacaggggcaccgcatggtgatatttgttaaagatttattggtgatagatgggcatgcgttcgattagctagttggcggggtaacggcccaccaaggcgacgatcgataggggagctgagaggttgatcccccacacgggcactgagatacgggcccgactcctacgggaggcagcagtagggaatattgggcaatggatgcaagtctgacccagccatgccgcgtgccggatgaaggccctcagggttgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggctttataagtcagtggtgaaatacggttgctcaacaatcgaggtgccattgatactgtaaagcttgaaataattggaggctgccggaatggatggtgtagcggtgaaatgcatagatatcatccagaacaccgattgcgaaggcaggtggctacgattggtttgacactgaggcacgaaagcatggggagcaaacaggattagataccctggtagtccatgctgtaaacgatgaggactcgttgtttgacggtaacgttgagcgacttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcacagaggaattatgcagaaatgtgtaagctagcaatagtctctgtgaaggtgctgcatggctgtcgtcagctcgtgtcgtgagatgttgggttaagtcccgcaacgagcgcaacccctatggttagttgccagcacgtaatggtggggactctagccagactgcctgtgcaaacagagaggaaggaggggacgacgtcaagtcatcatggcccttacgtccagggcaacacacgtgctacaatgggcggtacagagggttgctacacagcgatgtgatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcggtaggttaaagacaccgttagggtaaaatcggcgactggggctaagtcgtaacaaggtagccgtaccggaaggtgcggctggaacacctcctttctggag

SEQ ID NO: 3372 - DNA, 1060 bp, Dyadobacter psychrophilus
  ref <308>: DATABASE ACCESSION NUMBER: NCBI ACCESSION: NZ_FUZA01000032.1
  ref <309>: DATABASE ENTRY DATE: 2019-04-01
  ref <313>: RELEVANT RESIDUES IN SEQ ID NO: (1)..(1060)
tgtgtgacggtaccgaatgaataagcaccggctaactccgtgccagcagccgcggtaatacggagggtgcgagcgttgtccggatttattgggtttaaagggtgcgtaggtggctatttaagtcagtggtgaaatacagccgctcaacggttgaggtgccattgatactgaatagcttgaaagaattggaggctgccggaatggatggtgtagcggtgaaatgcatagatatcatccagaacaccgattgcgaaggcaggtggctacgatttatttgacactgaggcacgaaagcatggggagcaaacaggattagataccctggtagtccatgccgtaaacgatgaggactcgctgttggcctgtcacgggtcagcggcttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcacaatagaattgcgcagaaatgtgtaagccagcaatggctgttgtgaaggtgctgcatggctgtcgtcagctcgtgtcgtgagatgttgggttaagtcccgcaacgagcgcaacccctatggttagttgccagcacgtaatggtggggactctagccagactgcctgtgcaaacagagaggaaggaggggacgacgtcaagtcatcatggcccttacgtccagggcaacacacgtgctacaatgggcggtacagagggtagctacacagtgatgtgatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcagtaggttaaagacactgttagggtaaaatcggcgactggggctaagtcgtaacaaggtagccgtaccggaaggtgcggctggaacacctcctttctggag

SEQ ID NO: 3373 - DNA, 1439 bp, Dyadobacter soli
  ref <308>: DATABASE ACCESSION NUMBER: NCBI ACCESSION: NZ_FNAN01000045.1
  ref <309>: DATABASE ENTRY DATE: 2019-04-01
  ref <313>: RELEVANT RESIDUES IN SEQ ID NO: (1)..(1439)
aatgtcactgtcgtacgggtgcgtaacgcgtatgcaacctacctatcactgggggatagcccggggaaacccggattaataccgcataaaacaggggcaccgcatggtgatatttgttaaagatttattggtgatagatgggcatgcgttcgattagctagttggcggggtaacggcccaccaaggcgacgatcgataggggagctgagaggttgatcccccacacgggcactgagatacgggcccgactcctacgggaggcagcagtagggaatattgggcaatggatgcaagtctgacccagccatgccgcgtgccggatgaaggccctcagggttgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggctttataagtcagtggtgaaatacggttgctcaacaatcgaggtgccattgatactgcaaagcttgaaataattggaggctgccggaatggatggtgtagcggtgaaatgcatagatatcatccagaacaccgattgcgaaggcaggtggctacgattggtttgacactgaggcacgaaagcatggggagcaaacaggattagataccctggtagtccatgctgtaaacgatgaggactcgttgtttggcagtaatgctgagcgacttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcagacaggaattatgcagaaatgtgtaagccagcaatggcctgtttgaaggtgctgcatggctgtcgtcagctcgtgtcgtgagatgttgggttaagtcccgcaacgagcgcaacccctatggttagttgccagcacgtaatggtggggactctagccagactgcctgtgcaaacagagaggaaggaggggacgacgtcaagtcatcatggcccttacgtccagggcaacacacgtgctacaatgggcggtacagagggttgctacacagcgatgtgatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcggtaggttaaagacaccgttagggtaaaatcggcgactggggctaagtcgtaacaaggtagccgtaccggaaggtgcggctggaacacctcctttctggag

SEQ ID NO: 3374 - DNA, 1515 bp, Dyadobacter sp. Leaf189
  ref <308>: DATABASE ACCESSION NUMBER: NCBI ACCESSION: NZ_LMPS01000001.1
  ref <309>: DATABASE ENTRY DATE: 2019-04-01
  ref <313>: RELEVANT RESIDUES IN SEQ ID NO: (1)..(1515)
tttacaatggagagtttgatcctggctcaggatgaacgctagcggcaggcttaatacatgcaaggcgaaggggcagcaatgtcactgtcgtacgggtgcgtaacgcgtatgcaacctaccttttactgggggatagcccggggaaacccggattaataccgcatactacattaaggccacctggtttaaatgtgaaagatttattggtaaaagatgggcatgcgttcgattagctagttggcagggtaacggcctaccaaggcgacgatcgataggggagctgagaggttgatcccccacacgggcactgagatacgggcccgactcctacgggaggcagcagtagggaatattgggcaatggatgcaagtctgacccagccatgccgcgtgccggaagaaggtcctcaggattgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggcttgataagtcagtggtgaaatacagccgctcaacggttgaggtgccattgatactgtcaagcttgaaagaattggaggctgccggaatggatggtgtagcggtgaaatgcatagatatcatccagaacaccgattgcgaaggcaggtggctacgatttatttgacactgaggcacgaaagcatggggagcaaacaggattagataccctggtagtccatgccgtaaacgatgaggactcgctgttggtgcacccgcatcagcggcttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcacaatagaattacgcagaaatgcgtaagccagcaatggctgttgtgaaggtgctgcatggctgtcgtcagctcgtgtcgtgagatgttgggttaagtcccgcaacgagcgcaacccctatgattagttgccagcacgtaatggtggggactctagtcagactgcctgtgcaaacagagaggaaggaggggacgacgtcaagtcatcatggcccttacgtccagggcaacacacgtgctacaatgggcggtacagagggtagctacactgcgaggtgatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcggtaggttaaagacaccgttagggtaaaatcggcgactggggctaagtcgtaacaaggtagccgtaccggaaggtgcggctggaacacctcctttctggag

SEQ ID NO: 3375 - DNA, 1512 bp, Dyadobacter sp. RS19
  ref <308>: DATABASE ACCESSION NUMBER: NCBI ACCESSION: NZ_QNUL01000054.1
  ref <309>: DATABASE ENTRY DATE: 2019-04-01
  ref <313>: RELEVANT RESIDUES IN SEQ ID NO: (1)..(1512)
tttacaatggagagtttgatcctggctcaggatgaacgctagcggcaggcttaatacatgcaaggcgaaggggcagcaatgtcactgtcgtacgggtgcgtaacgcgtatgcaacctacctataactgggggatagcccggggaaacccggattaataccgcataatacatggatgtagcattacattttttgttaaagatttattggttatagatgggcatgcgttcgattagctagttggtatgggtaacggcctaccaaggcgacgatcgataggggagctgagaggttgatcccccacacgggcactgagatacgggcccgactcctacgggaggcagcagtagggaatattgggcaatggatgcaagtctgacccagccatgccgcgtgccggatgaaggccctcagggttgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggctttataagtcagtggtgaaatacagccgctcaacggttgaggtgccattgatactgtagagcttgaaataattggaggctgccggaatggatggtgtagcggtgaaatgcatagatatcatccagaacaccgattgcgaaggcaggtggctacgatttatttgacactgaggcacgaaagcatggggagcaaacaggattagataccctggtagtccatgccgtaaacgatgaggactcgctgtttggctgtcacggctgagcggcttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcacagtagaattatccagaaatgggtaagccagcaatggctgctgtgaaggtgctgcatggctgtcgtcagctcgtgtcgtgagatgttgggttaagtcccgcaacgagcgcaacccctatgtttagttgccagcacgtaatggtggggactctagacagactgcctgtgcaaacagagaggaaggaggggacgacgtcaagtcatcatggcccttacgtccagggcaacacacgtgctacaatgggcggtacagagggtagctacactgcgaggtgatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcagtaggttaaagacactgttagggtaaaatcggcgactggggctaagtcgtaacaaggtagccgtaccggaaggtgcggctggaacacctccttt

SEQ ID NO: 3376 - DNA, 1265 bp, Dyadobacter sp. SG02
  ref <308>: DATABASE ACCESSION NUMBER: NCBI ACCESSION: NZ_FNYL01000036.1
  ref <309>: DATABASE ENTRY DATE: 2019-04-01
  ref <313>: RELEVANT RESIDUES IN SEQ ID NO: (1)..(1265)
ggcccaccaaggcgacgatcgataggggagctgagaggttgatcccccacacgggcactgagatacgggcccgactcctacgggaggcagcagtagggaatattgggcaatggatgcaagtctgacccagccatgccgcgtgccggatgaaggccctcagggttgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgattggtttgacactgaggcacgaaagcatggggagcaaacaggattagataccctggtagtccatgctgtaaacgatgaggactcgctgtttgatggcaacattgagcggcttagggaaaccgttaagtcctccacctggggagtacgccggcaacggtgaaactcaaaggaattgacgggggtccgcacaagcggtggagcatgtggtttaattcgatgatacgcgaggaaccttacctgggctaaatcagagaggaattatgcagaaatgtgtaagccagcaatggtctctttgaaggtgctgcatggctgtcgtcagctcgtgtcgtgagatgttgggttaagtcccgcaacgagcgcaacccctatggttagttgccagcacgtaatggtggggactctagccagactgcctgtgcaaacagagaggaaggaggggacgacgtcaagtcatcatggcccttacgtccagggcaacacacgtgctacaatgggcggtacagagggttgctacacagcgatgtgatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcggtaggttaaagacaccgttagggtaaaatcggcgactggggctaagtcgtaacaaggtagccgtaccggaaggtgcggctggaacacctcctttctggag

SEQ ID NO: 3377 - DNA, 1517 bp, Dyadobacter tibetensis
  ref <308>: DATABASE ACCESSION NUMBER: NCBI ACCESSION: NZ_AZQN01000011.1
  ref <309>: DATABASE ENTRY DATE: 2019-04-01
  ref <313>: RELEVANT RESIDUES IN SEQ ID NO: (1)..(1517)
tttacaatggagagtttgatcctggctcaggatgaacgctagcggcaggcttaatacatgcaaggcgagggggcacttcggtgtcaccgtcgtacgggtgcgtaacgcgtatgcaacctaccttcaacagggggatagcccggggaaacccggattaataccgcataacacagtgaacctgcatgggtttattagttaaagatttattggttgaagatgggcatgcgttcgattagctagttggcggggtaacggcccaccaaggcgacgatcgataggggagctgagaggttgatcccccacacgggcactgagatacgggcccgactcctacgggaggcagcagtagggaatattgggcaatggatgcaagtctgacccagccatgccgcgtgccggaagaaggccctcagggttgtaaacggcttttattcgggaagaagagcagggatgcgtccttgtgtgacggtaccgaatgaataagcaccggctaactccgtgccagcagccgcggtaatacggagggtgcgagcgttgtccggatttattgggtttaaagggtgcgtaggtggctttgtaagtcagtggtgaaatacatccgcttaacggatgaggtgccattgatactgcagagcttgaaagaattggaggctgccggaatggatggtgtagcggtgaaatgcatagatatcatccagaacaccgattgcgaaggcaggtggctacgatttatttgacactgaggcacgaaagcatggggagcaaacaggattagataccctggtagtccatgccgtaaacgatgatgactcgctgttggtacttagtatcagcggcttagggaaaccgttaagtcatccacctggggagtacgccggcaacggtgaaactcaaaggaattgacgggggtccgcacaagcggtggagcatgtggtttaattcgatgatacgcgaggaaccttacctgggctaaatcaaagaggaattattcagaaatgagtaagctagcaatagtctctttgaaggtgctgcatggctgtcgtcagctcgtgtcgtgagatgttgggttaagtcccgcaacgagcgcaacccctatgattagttgccagcacataatggtggggactctaatcagactgcctgtgcaaacagagaggaaggaggggacgacgtcaagtcatcatggcccttacgtccagggcaacacacgtgctacaatgggcggtacagagggtagctactcagcgatgagatgccaatcccaaaaagccgttctcagttcggattggagtctgcaactcgactctatgaagctggaatcgctagtaatcgcgtatcagctatgacgcggtgaatacgttcccggaccttgtacacaccgcccgtcaagccatgggagtcggggagacctgaagcagtaggttaaagacactgttagggtaaaatcggcgactggggctaagtcgtaacaaggtagccgtaccggaaggtgcggctggaacacctcctttctggag

SEQ ID NO: 3378 - DNA, 1542 bp, Dyella sp. M7H15-1
  ref <308>: DATABASE ACCESSION NUMBER: NCBI ACCESSION: NZ_CP035300.1
  ref <309>: DATABASE ENTRY DATE: 2019-04-01
  ref <313>: RELEVANT RESIDUES IN SEQ ID NO: (1)..(1542)
taagtgaagagtttgatcctggctcagattgaacgctggcggcatgcctaacacatgcaagtcgaacggcagcacaggtagcaataccgggtggcgagtggcggacgggtgaggaaagcatcgggacctgcccagacgtgggggataacgtagggaaacttacgctaataccgcatacgtcctacgggagaaagcgggggatcgcaagacctcgcgcggttggatggaccgatgttcgattagctagttggtgaggtaatggctcaccaaggcgacgatcgatagctggtctgagaggatgatcagccacactgggactgagacacggcccagactcctacgggaggcagcagtggggaatattggacaatgggcgcaagcctgatccagcaatgccgcgtgtgtgaagaaggccttcgggttgtaaagcacttttatcaggagcgaaatgttaccggttaatacccggtgaagctgacggtacctgaggaataagcaccggctaacttcgtgccagcagccgcggtaatacgaagggtgcaagcgttaatcggaattactgggcgtaaagcgtgcgtaggcggtggcttaagtctgctgtgaaatccccgggctcaacctgggaatggcagtggatactgagtcgctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgtcgagaacctttcagagatgagagggtgccttcgggaactcgaacacaggtgctgcatggctgtcgtcagctcgtgtcgtgagatgttgggttaagtcccgcaacgagcgcaacccttgtccttagttgccagcacgtaaaggtgggaactctaaggagactgccggtgacaaaccggaggaaggtggggatgacgtcaagtcatcatggcccttacggccagggctacacacgtactacaatggtcggtacagagggttgcgaagccgcgaggtgaagccaatcccagaaagccgatcccagtccggatcgaagtctgcaactcgacttcgtgaagtcggaatcgctagtaatcgcagatcagctatgctgcggtgaatacgttcccgggccttgtacacaccgcccgtcacaccatgggagtgagttgctccagaagccgttagcctaaccgcaaggagggcgacgaccacggagtgattcatgactggggtgaagtcgtaacaaggtagccgtatcggaaggtgcggctggatcacctcctttc

SEQ ID NO: 3379 - DNA, 1128 bp, Echinicola pacifica
  ref <308>: DATABASE ACCESSION NUMBER: NCBI ACCESSION: NZ_KB890753.1
  ref <309>: DATABASE ENTRY DATE: 2019-04-01
  ref <313>: RELEVANT RESIDUES IN SEQ ID NO: (1)..(1128)
tttacaatggagagtttgatcctggctcaggatgaacgctagcggcaggcctaatacatgcaagtcgaacggtagtcttgatttatcaagatgagagtggcgcacgggtgcgtaacgcgtatgcaacctaccctttacagggggatagcccggggaaacccggattaataccccatagtatctttgaatggcatcgtttaaagattaaagattcatcggtaaaggatgggcatgcgtaggattagctagttggtgtggtaacggcacaccaaggcgacgatccttaggggttctgagaggaaggtcccccacactggcactgagatacgggccagactcctacgggaggcagcagtagggaatattggtcaatgggtgagagcctgaaccagccatgccgcgtgcaggaagacggcgttctgcgttgtaaactgcttttatacgggaagaaaaggcccatgcgtgggacattgccggtaccgtatgaataagcaccggctaactccgtgccagcagccgcggtaatacggagggtgcaagcgttgtccggatttattgggtttaaagggtgcgtaggcggtcctataagtcagcggtgaaagtttaaggctcaaccttaaaattgccgttgatactgtaggacttgagtgccgatggggtacatggaatttatggtgtagcggtgaaatgcatagataccataaggaacaccgatagcgaaggcattgtactgatcggcaactgacgctgaggcacgaaagcgtgggtagcgaacaggattagataccctggtagtccacgccgtaaacgatgattactcgctgttatctctttaatggggtagtggccaagcgaaagcgttaagtaatccacctggggagtacgccggcaacggtgaaactcaaaggaattgacgggggtccgcacaagcggtggagcatgtggtttaattcgatgatacgcgaggaaccttacctgggctagaatgcgagtgctttactgagagatcagtattttcttcggaacacgaagcaaggtgctgcatggctgtcgtcagctcgtgccgtgaggtgttgggttaagtcccgcaacgagcgcaacccctgtgtccagttgccatcaggttaa

SEQ ID NO: 3380 - DNA, 1528 bp, Echinicola strongylocentroti
  ref <308>: DATABASE ACCESSION NUMBER: NCBI ACCESSION: NZ_CP030041.1
  ref <309>: DATABASE ENTRY DATE: 2019-04-01
  ref <313>: RELEVANT RESIDUES IN SEQ ID NO: (1)..(1528)
tttacaatggagagtttgatcctggctcaggatgaacgctagcggcaggcctaatacatgcaagtcgaacggtatgtcggtcttcggattggcagagagtggcgcacgggtgcgtaacgcgtatgcaacctaccttccacagggggatagcccggggaaacccggattaataccccatggcatatagggacggcatcgtcctgatattaaagattcatcggtggaagatgggcatgcgtaggattagctagttggtgcggtaacggcgcaccaaggcgatgatccttaggggttctgagaggaaggtcccccacactggcactgagatacgggccagactcctacgggaggcagcagtagggaatattggtcaatgggcgatagcctgaaccagccatgccgcgtgcaggaagacggccttacgggttgtaaactgcttttgtacgggaagaaaaggcccatgcgtgggacattgccggtaccgtacgaataagcaccggctaactccgtgccagcagccgcggtaatacggagggtgcaagcgttgtccggatttattgggtttaaagggtgcgtaggcggcccgttaagtcagtggtgaaagttttgggctcaacccaaaaattgccattgatactggcgggcttgagtgccgatggggtacatggaatttatggtgtagcggtgaaatgcatagataccataaggaacaccgatagcgaaggcattgtactgatcggcaactgacgctgaggcacgaaagcgtgggtagcgaacaggattagataccctggtagtccacgccgtaaacgatgatcactcgctgttatgcctgtatggtgtagtggccaagcgaaagcgttaagtgatccacctggggagtacgccggcaacggtgaaactcaaaggaattgacgggggtccgcacaagcggtggagcatgtggtttaattcgatgatacgcgaggaaccttacctgggctagaatgcgagtgccgcacgtagagatgcgtgtttccttcgggacacgaagcaaggtgctgcatggctgtcgtcagctcgtgccgtgaggtgttgggttaagtcccgcaacgagcgcaacccctgtgtccagttgccagcaagtaatgttggggactctggacagactgcctgcgcaagcagagaggaaggaggggacgacgtcaagtcatcatggcccttacgcccagggcgacacacgtgctacaatggcgcatacagcgggtagcgatccggcaacggtaagccaacctctaaaagtgcgtctcagttcggatcggggcctgcaactcggccccgtgaagctggaatcgctagtaatcgcgcatcagccatggcgcggtgaatacgttcccggaccttgtacacaccgcccgtcaagccatggaagtcgggtagacctgaaggcagtaaccgtcaaggagctgtttagggtagaaccggtaactggggctaagtcgtaacaaggtagccgtaccggaaggtgcggctggaacacctcctttct

SEQ ID NO: 3381 - DNA, 1528 bp, Echinicola vietnamensis
  ref <308>: DATABASE ACCESSION NUMBER: NCBI ACCESSION: NC_019904.1
  ref <309>: DATABASE ENTRY DATE: 2019-04-01
  ref <313>: RELEVANT RESIDUES IN SEQ ID NO: (1)..(1528)
tacaatggagagtttgatcctggctcaggatgaacgctagcggcaggcctaatacatgcaagtcgaacggtatcccggacttgtttcgggagagagtggcgcacgggtgcgtaacgcgtatgcaacctaccttccacagggggatagcccggggaaacccggattaataccccatggcatattggaccggcatcggtactatattaaagattcatcggtggaagatgggcatgcgtaggattagctggttggtgcggtaacggcgcaccaaggcgacgatccttaggggttctgagaggaaggtcccccacactggcactgagatacgggccagactcctacgggaggcagcagtagggaatattggtcaatgggcgggagcctgaaccagccatgccgcgtgcaggaagacggccttacgggttgtaaactgcttttgtacgggaagaaaaggcccatgcgtgggacattgccggtaccgtacgaataagcaccggctaactccgtgccagcagccgcggtaatacggagggtgcaagcgttgtccggatttattgggtttaaagggtgcgtaggcggcccggtaagtcagcggtgaaagtttccggctcaaccgggaaactgccgttgatactgtcgggcttgagtgccgatggggtacatggaatttatggtgtagcggtgaaatgcatagataccataaggaacaccgatagcgaaggcattgtactgatcggcaactgacgctgaggcacgaaagcgtgggtagcgaacaggattagataccctggtagtccacgccgtaaacgatgatcactcgctgttatgccgataaggtgtagtggccaagcgaaagcgttaagtgatccacctggggagtacgccggcaacggtgaaactcaaaggaattgacgggggtccgcacaagcggtggagcatgtggtttaattcgatgatacgcgaggaaccttacctgggctagaatgcgagtgccgcatcgggagaccgatgttttcttcggaacacgaagcaaggtgctgcatggctgtcgtcagctcgtgccgtgaggtgttgggttaagtcccgcaacgagcgcaacccctgtgtccagttgccatcaggttaagctggggactctggacagactgcctgcgcaagcagagaggaaggaggggacgacgtcaagtcatcatggcccttacgcccagggcgacacacgtgctacaatggcgcatacaacgggtagcggtccggcaacggtaagccaacctctaaaagtgcgtctcagttcggatcggggcctgcaactcggccccgtgaagctggaatcgctagtaatcgcgcatcagccatggcgcggtgaatacgttcccggaccttgtacacaccgcccgtcaagccatggaagtcgggtagacctgaaggcagtaaccgtcaaggagctgtttagggtagaaccggtaactggggctaagtcgtaacaaggtagccgtaccggaaggtgcggctggaacacctcctttctgga

SEQ ID NO: 3382 - DNA, 1557 bp, Edaphobacillus lindanitolerans
  ref <308>: DATABASE ACCESSION NUMBER: NCBI ACCESSION: NZ_FTPL01000008.1
  ref <309>: DATABASE ENTRY DATE: 2019-04-01
  ref <313>: RELEVANT RESIDUES IN SEQ ID NO: (1)..(1557)
ctcttatggagagtttgatcctggctcaggacgaacgctggcggcgtgcctaatacatgcaagtcgagcggatgacgaggagcttgctcctctgattcagcggcggacgggtgagtaacacgtgggcaacctgcctgcaagatcgggataactccgggaaaccggggctaataccggatggttccttcctccgcatggaggaaggcggaaagacggtttcggctgtcacttgcagatgggcccgcggcgcattagctggttggtggggtaatggcccaccaaggcgacgatgcgtagccgacctgagagggtgatcggccacactgggactgagacacggcccagactcctacgggaggcagcagtagggaatcttccgcaatggacgaaagtctgacggagcaacgccgcgtgagcgaagaaggccttcgggtcgtaaagctctgttgtaagggaagaacaagtgccggttaactgccggtgccctgacggtaccttaccagaaagccacggctaactacgtgccagcagccgcggtaatacgtaggtggcaagcgttgtccggaatcattgggcgtaaagcgcgcgcaggcggtttcttaagtctgatgtgaaagcccacggctcaaccgtggagggtcattggaaactggggaacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgaccaccctggagacagggctttccccttcgggggacaaagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacggtacagagggctgcaaacccgcgagggggagccaatcccagaaaaccgttcccagttcggattgcaggctgcaactcgcctgcatgaagccggaatcgctagtaatcgcggatcagcatgccgcggtgaatacgttcccgggtcttgtacacaccgcccgtcacaccacgagagtttgcaacacccgaagtcggtggggtaacccttacgggagccagccgccgaaggtggggcagatgattggggtgaagtcgtaacaaggtagccgtatcggaaggtgcggctggatcacctcctttctaa

SEQ ID NO: 3383 - DNA, 1496 bp, Edaphobacter aggregans
  ref <308>: DATABASE ACCESSION NUMBER: NCBI ACCESSION: NZ_RSDW01000001.1
  ref <309>: DATABASE ENTRY DATE: 2019-04-01
  ref <313>: RELEVANT RESIDUES IN SEQ ID NO: (1)..(1496)
gagagtttgatcctggctcagaatcaacgctggcggcgtgcctaacacatgcaagtcgcacgagaaaggggcttcggctctgagtaaagtggcgcacgggtgagtaacacgtgaattatctacctccgagtggggaataactgagagaaatcttagctaataccgcataacacttacgagtcaaagcagcaatgcgcttggagaggagttcgcggccgattagttagttggcggggtaatggcccaccaagacgatgatcggtatccggcctgagagggcgcacggacacactggaactgaaacacggtccagactcctacgggaggcagcagtggggaattttgcgcaatgggggaaaccctgacgcagcaacgccgcgtggaggatgaaatcccttgggatgtaaactcctttcgatagggaagataatgacggtacctatagaagaagccccggctaacttcgtgccagcagccgcggtaatacgaggggggcaagcgttgttcggaattattgggcgtaaagggcgcgtaggcggtttgacaagtctgatgtgaaatctctgggctcaacccagagtctgcattagaaactgtcgggcttgagtatgggagaggtgagtggaatttccggtgtagcggtgaaatgcgtagatatcggaaggaacacctgtggcgaaagcggctcactggaccataactgacgctgaggcgcgaaagctaggggagcaaacaggattagataccctggtagtcctagccctaaacgatgattgcttgatgtggcaggtacccaatcctgccgtgtcgaagctaacgcgataagcaatccgcctggggagtacggtcgcaaggctgaaactcaaaggaattgacgggggcccgcacaagcggtggagcatgtggtttaattcgacgcaacgcgaagaaccttacctgggctcgaaatgtagtggaccggggtagaaatatccctttctagcaatagactgctatataggtgctgcatggctgtcgtcagctcgtgtcgtgagatgttgggttaagtcccgcaacgagcgcaacccttatcttcagttgctaccatttagttgagcactctgacgaaaccgcctcggataacggggaggaaggtggggatgacgtcaagtcctcatggcctttatgtccagggctacacacgtgctacaatggccggtacaaaccgctgcaaacccgcgagggggagctaatcggaaaaagccggcctcagttcggattggagtctgcaactcgactccatgaagctggaatcgctagtaatcgtggatcagcatgccacggtgaatacgttcccgggccttgtacacaccgcccgtcacatcacgaaagtgggttgcactagaagtcggtgcgctaaccgcaagggagcagccgcccaaggtgtaattcatgattggggtgaagtcgtaacaaggtagccgtaggagaacctgcggctggatcacctcctttct

SEQ ID NO: 3384 - DNA, 1497 bp, Edaphobacter dinghuensis
  ref <308>: DATABASE ACCESSION NUMBER: NCBI ACCESSION: NZ_RBIF01000001.1
  ref <309>: DATABASE ENTRY DATE: 2019-04-01
  ref <313>: RELEVANT RESIDUES IN SEQ ID NO: (1)..(1497)
gagagtttgatcctggctcagaatcaacgctggcggcgtgcctaacacatgcaagtcgcacgagaaagggtagcaatacctgagtaaagtggcgcacgggtgagtaacacgtgactaatctaccctcgagtggggaataactgagagaaatcttagctaataccgcataacacttacgagtcaaagcagcaatgcgcttggggaggaggtcgcggccgattagttagttggcggggtaatggcccaccaagacgatgatcggtatccggcctgagagggcgcacggacacactggaactgaaacacggtccagactcctacgggaggcagcagtggggaattttgcgcaatgggggaaaccctgacgcagcaacgccgcgtggaggatgaaatcccttgggatgtaaactcctttcgatagggaagataatgacggtacctatagaagaagccccggctaacttcgtgccagcagccgcggtaatacgaggggggcaagcgttgttcggatttattgggcgtaaagggtgcgtaggcggtttggcaagtcttatgtgaaatctttgggctcaacccaaagtctgcataagaaactgccgggcttgagtatgggagaggtgagtggaatttccggtgtagcggtgaaatgcgtagatatcggaaggaacacctgtggcgaaagcggctcactggaccattactgacgctgaggcacgaaagctaggggagcaaacaggattagataccctggtagtcctagccctaaacgatgattgtttgatgtggcaggtacccaatcctgccgtgtcgaagctaacgcgataaacaatccgcctggggagtacggtcgcaaggctgaaactcaaaggaattgacgggggcccgcacaagcggtggagcatgtggtttaattcgacgcaacgcgaagaaccttacctgggctcgaaatgtagtggaatccggcagaaacgtcggcgtctagcaatagaccgctatataggtgctgcatggctgtcgtcagctcgtgtcgtgagatgttgggttaagtcccgcaacgagcgcaacccttatcttcagttgctaccatttagttgagcactctgacgaaaccgcctcggataacggggaggaaggtggggatgacgtcaagtcctcatggcctttatgtccagggctacacacgtgctacaatggccggtacaaaccgctgcaaccccgcgagggtgagctaatcggaaaaagccggcctcagttcggattggagtctgcaactcgactccatgaagctggaatcgctagtaatcgtggatcagcatgccacggtgaatacgttcccgggccttgtacacaccgcccgtcacatcacgaaagtgggttgtactagaagtcggtgcgctaaccgcaaggaagcagccgcccaaggtgtaattcatgattggggtgaagtcgtaacaaggtagccgtaggagaacctgcggctggatcacctcctttcta

SEQ ID NO: 3385 - DNA, 813 bp, Edwardsiella anguillarum
  ref <308>: DATABASE ACCESSION NUMBER: NCBI ACCESSION: NZ_NMPN01000089.1
  ref <309>: DATABASE ENTRY DATE: 2019-04-01
  ref <313>: RELEVANT RESIDUES IN SEQ ID NO: (1)..(813)
ttaattgaagagtttgatcatggctcagattgaacgctggcggcaggcttaacacatgcaagtcgagcggtagcagggagaaagcttgctttctccgctgacgagcggcggacgggtgagtaatgtctggggatctgcctgatggagggggataactactggaaacggtagctaataccgcataacgtcgcaagaccaaagtgggggaccttcgggcctcatgccatcagatgaacccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtgtgagcgttaatagcgttcacaattgacgttacctacagaagaagcaccggctaactccgtgccagcagccgcggtaatacggagggtgcaagcgttaatcggaattactgggcgtaaagcgcacgcaggcggtttgttaagttggatgtgaaatccccgggcttaacctgggaactgcatccaagactggcaagctagagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgc

SEQ ID NO: 3386 - DNA, 1554 bp, Edwardsiella piscicida
  ref <308>: DATABASE ACCESSION NUMBER: NCBI ACCESSION: NZ_CP035668.1
  ref <309>: DATABASE ENTRY DATE: 2019-04-01
  ref <313>: RELEVANT RESIDUES IN SEQ ID NO: (1)..(1554)
ttaattgaagagtttgatcatggctcagattgaacgctggcggcaggcttaacacatgcaagtcgagcggtagcagggagaaagcttgctttctccgctgacgagcggcggacgggtgagtaatgtctggggatctgcctgatggagggggataactactggaaacggtagctaataccgcataacgtcgcaagaccaaagtgggggaccttcgggcctcatgccatcagatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtaggggaggaaggtgtgaacgttaatagcgctcacaattgacgttacctacagaagaagcaccggctaactccgtgccagcagccgcggtaatacggagggtgcaagcgttaatcggaattactgggcgtaaagcgcacgcaggcggtttgttaagttggatgtgaaatccccgggcttaacctgggaactgcatccaagactggcaagctagagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgctgtaaacgatgtcgatttggaggttgtgcccttgaggcgtggcttccgaagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagcgaatcctgtagagatacgggagtgccttcgggaacgctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 3387 - DNA, 1575 bp, Edwardsiella tarda
  ref <308>: DATABASE ACCESSION NUMBER: NCBI ACCESSION: NZ_UFYP01000001.1
  ref <309>: DATABASE ENTRY DATE: 2019-04-01
  ref <313>: RELEVANT RESIDUES IN SEQ ID NO: (1)..(1575)
ttaattgaagagtttgatcatggctcagattgaacgctggcggcaggcttaacacatgcaagtcgagcggtagcagggagaaagcttgctttctcccgctgacgagcggcggacgggtgagtaatgtctggggatctgcctgatggagggggataactactggaaacggtagctaataccgcataacgtcgcaagaccaaagtgggggaccttcgggcctcatgccatcagatgaacccagatgggattagctagtaggtgaggtaatggctcacctaggcgacgatccctagctggtctgagaggatgaccagccacactggaactgagacacggtccagactcctacgggaggcaagcagtggggaatattgcacaatgggcgcaagcctgatgcagccatgccgcgtgttatgaagaaggccttcgggttgtaaagtactttcagtagggaggaaggtgtgcgtgttaatagcacgtacaattgacgttacctacagaagaagcaccgctaactccgtgccagcagccgcggtaatacggagggtgcaagcgttaatcggaattactgggcgtaaagcgcacgcaggcggtttgttaagttggatgtgaaatccccgggcttaacctgggaaactgcatccaagactggcaagctagagtctcgtagagggaggtagaattccaggtgtagcggtgaaatgcgtagagatctggaggaataccggtggcgaaggcggcctcctgacgaagactgacgctcaggtgcgaaagcgtggggagcaaacaggattagataccctggtagtccaacgctgtaaacgatgtcgatttggaggttgtgcccttgaggcgtggcttccgaagctaacgcgttaaatcgaccgcctggggagtacggccgcaaggtttaaaactcaaatgaattgacggggggcccgcacaagcggtggagcatgtggttttaattcgatgcaacgcgaagaaaccttaacctactcttgacatccagcgaatcctgtagagatacgggagtgccttcgggaacgctgagacaggtggctgcatggctgtcgtcagctcgtgttgtgaaaatgttgggttaagtcccgcaacgagcgcaacccttatccttttgttgccagcggttcggccgggaactcaaaggagactgccagtgataaaactggaggaaggtgggggatgacgtcaaagtcatcatggcccttacgagtagggctacacacgtgcttacaatggcgtatacaaagagaaagcgacctcgcgagagcaagcggacctcataaagtacgtcgtaggtccggatttggagtctgcaactcgactccatgaagtcggaatcgcttagtaatcgtggatcagaatgccacggtgaatacgttcccgggccttgtaacacaccgcccgtcacaccatgggaagtgggttgcaaaagaagtaggtaagcttaaccttcgggagggcgcttaccacttttgtgattcatgactgggggtgaagtcgtaacaaggtaaccgtaggggaacctgcggttggatcacctccttacctgaa

SEQ ID NO: 3388 - DNA, 1007 bp, Effusibacillus lacus
  ref <308>: DATABASE ACCESSION NUMBER: NCBI ACCESSION: NZ_BDUF01000025.1
  ref <309>: DATABASE ENTRY DATE: 2019-04-01
  ref <313>: RELEVANT RESIDUES IN SEQ ID NO: (1)..(1007)
agagtttgatcctggctcaggacgaacgctggcggcgtgcctaatacatgcaagtcgcgcggcttgattcagagcttgctctgaggatggcagcggcggacgggtgagtaacacgtgggcaacctgcctgacagaccgggataacgcctggaaacgggtgctaataccggataggcaacgaagaggcatctcttggttgggaaaggcgctacggcgtcactgtcagatgggcccgcggcgcattagctggttggtgaggtaacggctcaccaaggcgacgatgcgtagccgacctgagagggtgaccggccacactgggactgagacacggcccagactcctacgggaggcagcagtagggaatcttccacaatgggcgcaagcctgatggagcaacgccgcgtgagtgacgaaggccttcgggttgtaaaactctgtctttcgggacgaacaggcgcaagagggaatgcttgcgttgtgacggtaccggaggaggaagccacggctaactacgtgccagcagccgcggtaatacgtaggtggcaagcgttgtccggaattactgggcgtaaagcgcgcgcaggcggccgcttaagtctggggtgaaaacccggggctcaacctcgggagtgccttggatactgggtggcttgaacatcggagaggcaaggggaattccacgtgtagcggtgaaatgcgtagagatgtggaggaacacctgtggcgaaggcgccttgctgggcgattgttgacgctgaggcgcgaaagcgtggggagcaaacaggattagataccctggtagtccacgccgtaaacgatgagtgctaggtgttggtggggtccacccatcagtgccgaagctaacgcattaagcactccgcctggggagtacgctcgcaagagtgaaactcaaaggaattgacgggggcccgcacaagcagtggagcatgtggtttaattcgaagcaacgcgaagaaccttaccaagacttgacatcccgctgaccg

SEQ ID NO: 3389 - DNA, 212 bp, Effusibacillus pohliae
  ref <308>: DATABASE ACCESSION NUMBER: NCBI ACCESSION: NZ_AQXL01000060.1
  ref <309>: DATABASE ENTRY DATE: 2019-04-01
  ref <313>: RELEVANT RESIDUES IN SEQ ID NO: (1)..(212)
ttttgagagtttgatcctggctcaggacgaacgctggcggcgtgcctaatacatgcaagtcgagcgggcggaaggggagcttgctctctggaagccagcggcggacgggtgagtaacacgtgggcaacctgcccggcagaccgggataacgcctggaaacgggtgctaataccggataggcgcagaggacgcatgttctgtgcgggaaaggc

SEQ ID NO: 3390 - DNA, 1518 bp, Eggerthella lenta
  ref <308>: DATABASE ACCESSION NUMBER: NCBI ACCESSION: NZ_QSSL01000005.1
  ref <309>: DATABASE ENTRY DATE: 2019-04-01
  ref <313>: RELEVANT RESIDUES IN SEQ ID NO: (1)..(1518)
ttaaacggagagtttgatcctggctcaggatgaacgctggcggcgtgcctaacacatgcaagtcgaacgatgaaaccgccctcgggcggacatgaagtggcgaacgggtgagtaacacgtgaccaacctgccccttgctccgggacaaccttgggaaaccgaggctaataccggatactcctcgcccccctcctggggggcccgggaaagcccagacggcaagggatggggtcgcggcccattaggtagtaggcggggtaacggcccacctagcccgcgatgggtagccgggttgagagaccgaccggccacattgggactgagatacggcccagactcctacgggaggcagcagtggggaattttgcgcaatgggggcaaccctgacgcagcaacgccgcgtgcgggacgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctctcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgcaactgacgctgaggcgcgaaagctaggggagcgaacaggattagataccctggtagtcctagccgtaaacgatggatactaggtgtggggggctccgccctccgtgccgcagccaacgcattaagtatcccgcctggggagtacggccgcaaggctaaaactcaaaggaattgacgggggcccgcacaagcagcggagcatgtggcttaattcgaagcaacgcgaagaaccttaccagggcttgacatggacgtgaagccggggaaacccggtggccgagaggagcgtccgcaggtggtgcatggctgtcgtcagctcgtgtcgtgagatgttgggttaagtcccgcaacgagcgcaacccctgccccatgttgccagcattaggttggggactcatgggggactgccggcgtcaagccggaggaaggtggggacgacgtcaagtcatcatgccctttatgccctgggctgcacacgtgctacaatggccggtacaacgggctgcgagaccgcgaggtcgagcgaatccctcaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaagtcgtaacaaggtagccgtaccggaaggtgcggctggatcacctcctttctagggag

SEQ ID NO: 3391 - DNA, 1520 bp, Eggerthella sinensis
  ref <308>: DATABASE ACCESSION NUMBER: NCBI ACCESSION: NZ_QICC01000173.1
  ref <309>: DATABASE ENTRY DATE: 2019-04-01
  ref <313>: RELEVANT RESIDUES IN SEQ ID NO: (1)..(1520)
ttaaacggagagtttgatcctggctcaggatgaacgctggcggcgtgcctaacacatgcaagtcgaacgattaaaccgtcctcggacggacatagagtggcgaacgggtgagtaacacgtgaccaacctgccccccgctccgggacaaccttgggaaaccgaggctaataccggatactcctcgcccccctcctggggggcccgggaaagcccagacggcgggggatggggtcgcggcccattaggtagacggcggggtaacggcccaccgtgcctgcgatgggtagccgggttgagagaccgaccggccacattgggactgagatacggcccagactcctacgggaggcagcagtggggaattttgcgcaatgggggaaaccctgacgcagcaacgccgcgtgcgggatgacggccttcgggttgtaaaccgctttcagcagggaagaaattcgacggtacctgcagaagaagctccggctaactacgtgccagcagccgcggtaatacgtagggagcgagcgttatccggattcattgggcgtaaagagcgcgtaggcggcctttcaagcgggatctctaatccgagggctcaacccccggccggatcccgaactgggaggctcgagttcggtagaggcaggcggaattcccggtgtagcggtggaatgcgcagatatcgggaagaacaccgatggcgaaggcagcctgctgggccgaaactgacgctgaggcgcgaaagctaggggagcgaacaggattagataccctggtagtcctagccgtaaacgatgggcgctaggtgtggggagggtcatcctctccgtgccgcagctaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgctagtgaagccggggaaacccggtggccgagaggagctagcgcaggtggtgcatggctgtcgtcagctcgtgtcgtgagatgttgggttaagtcccgcaacgagcgcaacccctatcgcatgttgccagcattcagttggggactcatgcgagactgccggcgtcaagccggaggaaggtggggacgacgtcaagtcatcatgccctttatgccctgggctgcacacgtgctacaatggccggtacaacgggctgcgaactcgcgagagtgagcgaatcccttaaagccggccccagttcggatcggaggctgcaacccgcctccgtgaagtcggagttgctagtaatcgcggatcagcatgccgcggtgaatacgttcccgggccttgtacacaccgcccgtcacaccacccgagtcgtctgcacccgaagccgccggccgaacccgcaaggggcggaggcgtcgaaggtgtggagggtaaggggggtgaagtcgtaacaaggtagccgtaccggaaggtgcggctggatcacctcctttctagggag

SEQ ID NO: 3392 - DNA, 1067 bp, Eggerthella sp. AM16-19
  ref <308>: DATABASE ACCESSION NUMBER: NCBI ACCESSION: NZ_QUCY01000047.1
  ref <309>: DATABASE ENTRY DATE: 2019-04-01
  ref <313>: RELEVANT RESIDUES IN SEQ ID NO: (1)..(1067)
tcgagggtacccgcagaagaagccccggctaaatacgtgccagcagccgcggtaatacgtatggggcgagcgttatccggattcattgggcgtaaagcgcgcgtaggcggagcgctaagcgggacctctaacccgagggctcaacccccggccgggtcccgaactggcgctctcgagtgcggtaggggagagcggaattcccggtgtagcggtggaatgcgcagatatcgggaagaacaccgacggcgaaggcagctctctgggccgaaactgacgctgaggcgcgaaagctgggggagcgaacaggattagataccctggtagtcccagccgtaaacgatgggcgctaggtgtgggggacgagatcccccgtgccgcagccaacgcattaagcgccccgcctggggagtacggccgcaaggctaaaactcaaaggaattgacgggggcccgcacaagcagcggagcatgtggcttaattcgaagcaacgcgaagaaccttaccagggcttgacatgcgggtgaagcggcggagacgccgtggccgagaggagcccgcacaggtggtgcatggctgtcgtcagctcgtgtcgtgagatgttgggttaagtcccgcaacgagcgcaacccctgccccgtgttgccagcattcagttggggactcgcgggggactgccggcgtcaagccggaggaaggtggggacgacgtcaagtcatcatgccccttatgccctgggccgcacacgtgctacaatggccggtacagagggttgcgaccccgcgagggggagcggatcccgcaaagccggccccagttcggatcggaggctgcaacccgcctccgtgaagccggagttgctagtaatcgcggatcagcacgccgcggtgaatacgttcccgggccttgtacacaccgcccgtcacaccacccgagtcgtctgcacccgaagccgccggccgaaccctttcaggggcggaggcgtcgaaggtgtggagggtgaggggggtgaagccgtaacaaggtagccgtaccggaaggtgcggctggatcacctcctttctagggag

SEQ ID NO: 3393 - DNA, 1509 bp, Ehrlichia canis
  ref <308>: DATABASE ACCESSION NUMBER: NCBI ACCESSION: NZ_CP025749.1
  ref <309>: DATABASE ENTRY DATE: 2019-04-01
  ref <313>: RELEVANT RESIDUES IN SEQ ID NO: (1)..(1509)
tcaaacttgagagtttgatcctggctcagaacgaacgctggcggcaagcctaacacatgcaagtcgaacggacaattatttatagcctctggctataggaaattgttagtggcagacgggtgagtaatgcgtaggaatctacctagtagtacggaatagccattagaaatggtgggtaatactgtataatccccgagggggaaagatttatcgctattagatgagcctacgttagattagctagttggtgaggtaatggcttaccaaggctatgatctatagctggtctgagaggacgatcagccacactggaactgagatacggtccagactcctacgggaggcagcagtggggaatattggacaatgggcgaaagcctgatccagctatgccgcgtgagtgaagaaggccttcgggttgtaaaactctttcaatagggaagataatgacggtacctatagaagaagtcccggcaaactctgtgccagcagccgcggtaatacggagggggcaagcgttgttcggaattattgggcgtaaagggcacgtaggtggactagtaagttaaaagtgaaataccaaagcttaactttggagcggcttttaatactgctagactagaggtcgaaagaggatagcggaattcctagtgtagaggtgaaattcgtagatattaggaggaacaccagtggcgaaggcggctatctggttcgatactgacactgaggtgcgaaagcgtggggagcaaacaggattagataccctggtagtccacgctgtaaacgatgagtgctaaatgtgaggattttatctttgtattgtagctaacgcgttaagcactccgcctggggactacggtcgcaagactaaaactcaaaggaattgacggggacccgcacaagcggtggagcatgtggtttaattcgatgctacgcgaaaaaccttaccactttttgacatgaaggtcgtatccctcctaacagggggagtcagttcggctggaccttacacaggtgctgcatggttgtcgtcagctcgtgtcgtgagatgttgggttaagtcccgcaacgagcgcaaccctcattcttagttaccaacaggtaatgctgggcactctaaggaaactgccagtgataaactggaggaaggtggggatgatgtcaaatcagcacggcccttatagggtgggctacacacgtgctacaatggcaactacaataggttgcgagaccgcaaggtttagctaatccataaaagttgtctcagttcggattgttctctgaaactcgagagcatgaagtcggaatcgctagtaatcgtggatcatcacgccacggtgaatacgttctcgggtcttgtacacactgcccgtcacgccatgggaattggcttaactcgaagctggtgtgctaaccgcaaggaagcagccatttaaggttgggttagtgactagggtgaagtcgtaacaaggtagctgtaggtgaacctgcggctggattacctccttt

SEQ ID NO: 3394 - DNA, 1511 bp, Ehrlichia chaffeensis
  ref <308>: DATABASE ACCESSION NUMBER: NCBI ACCESSION: NZ_CP007480.1
  ref <309>: DATABASE ENTRY DATE: 2019-04-01
  ref <313>: RELEVANT RESIDUES IN SEQ ID NO: (1)..(1511)
tcaaacttgagagtttgatcctggctcagaacgaacgctggcggcaagcctaacacatgcaagtcgaacggacaattgcttataaccttttggttataaataattgttagtggcagacgggtgagtaatgcgtaggaatctacctagtagtatggaatagccattagaaatgatgggtaatactgtataatccctgcgggggaaagatttatcgctattagatgagcctacgttagattagctagttggtaaggtaatggcttaccaaggctatgatctatagctggtctgagaggacgatcagccacactggaactgagatacggtccagactcctacgggaggcagcagtggggaatattggacaatgggcgaaagcctgatccagctatgccgcgtgagtgaagaaggccttcgggttgtaaaactctttcaatagggaagataatgacggtacctatagaagaagtcccggcaaactctgtgccagcagccgcggtaatacggagggggcaagcgttgttcggaattattgggcgtaaagggcacgtaggtggactagtaagttaaaagtgaaataccaaggcttaactttggagcggcttttaatactgctagactagaggtcgaaagaggatagcggaattcctagtgtagaggtgaaattcgtagatattaggaggaacaccagtggcgaaagcggctatctggttcgatactgacactgaggtgcgaaagcgtggggagcaaacaggattagataccctggtagtccacgctgtaaacgatgagtgctaaatgtgaggattttatctttgtattgtagctaacgcgttaagcactccgcctggggactacggtcgcaagactaaaactcaaaggaattgacggggacccgcacaagcggtggagcatgtggtttaattcgatgcaacgcgaaaaaccttaccactttttgacatgaaggtcgtatccctcctaatagggggagtcagttcggctggaccttacacaggtgctgcatggctgtcgtcagctcgtgtcgtgagatgttgggttaagtcccgcaacgagcgcaaccctcatccttagttaccaacaggtaatgctgggcactctaaggaaactgccagtgataaactggaggaaggtggggatgatgtcaagtcagcacggcccttataaggtgggctacacacgtgctacaatggcaactacaataggtcgcgagaccgcaaggtttagctaatccataaaagttgtctcagttcggattgttctctgcaactcgagagcatgaagtcggaatcgctagtaatcgtggatcatcatgccacggtgaatacgttctcgggtcttgtacacactgcccgtcacgccatgggaattggcttaactcgaagctggtgtgctaaccgcaaggaagcagccatttaaggttgggttagtgactagggtgaagtcgtaacaaggtagctgtaggtgaacctgcggctggattacctcctttt

SEQ ID NO: 3395 - DNA, 1509 bp, Ehrlichia minasensis
  ref <308>: DATABASE ACCESSION NUMBER: NCBI ACCESSION: NZ_QOHL01000005.1
  ref <309>: DATABASE ENTRY DATE: 2019-04-01
  ref <313>: RELEVANT RESIDUES IN SEQ ID NO: (1)..(1509)
tcaaacttgagagtttgatcctggctcagaacgaacgctggcggcaagcctaacacatgcaagtcgaacggacaattatttatagcttttggctataggcaattgttagtggcagacgggtgagtaatgcgtaggaatctacctagtagtacggaatagccattagaaatgatgggtaatactgtataatccccgcgggggaaagatttatcgctattagatgagcctacgttagattagctagttggtaaggtaatggcttaccaaggctatgatctatagctggtctgagaggacgatcagccacactggaactgagatacggtccagactcctacgggaggcagcagtggggaatattggacaatgggcgaaagcctgatccagctatgccgcgtgagtgaagaaggccttcgggttgtaaaactctttcaatagggaagataatgacggtacctatagaagaagtcccggcaaactctgtgccagcagccgcggtaatacggagggggcaagcgttgttcggaattattgggcgtaaagggcacgtaggtggactagtaagttaaaagtgaaataccaaagcttaactttggagcggcttttaatactgctagactagaggtcgaaagaggatagcggaattcctagtgtagaggtgaaattcgtagatattaggaggaacaccagttgcgaaggcggctatctggttcgatactgacactgaggtgcgaaagcgtggggagcaaacaggattagataccctggtagtccacgctgtaaacgatgagtgctaaatgtgaggattttatctttgtattgtagctaacgcgttaagcactccgcctggggactacggtcgcaagactaaaactcaaaggaattgacggggacccgcacaagcggtggagcatgtggtttaattcgatgctacgcgaaaaaccttaccactttttgacatgaaggtcgtatccctcctaacagggggagtcagttcggctggaccttacacaggtgctgcatggttgtcgtcagctcgtgtcgtgagatgttgggttaagtcccgcaacgagcgcaaccctcattcttagttaccaacaggtaatgctgggcactctaaggaaactgccagtgataaactggaggaaggtggggatgatgtcaaatcagcacggcccttataaggtgggctacacacgtgctacaatggcaactacaataggttgcgagaccgcaaggtttagctaatccataaaagttgtctcagttcggattgttctctgcaactcgagagcatgaagtcggaatcgctagtaatcgtggatcatcacgccacggtgaatacgttctcgggtcttgtacacactgcccgtcacgccatgggaattggcttaactcgaagctggtgtgctaaccgcaaggaagcagccatttaaggttgggttagtgactagggtgaagtcgtaacaaggtagctgtaggtgaacctgcggctggattacctccttt

SEQ ID NO: 3396 - DNA, 1511 bp, Ehrlichia muris
  ref <308>: DATABASE ACCESSION NUMBER: NCBI ACCESSION: NZ_LANU01000003.1
  ref <309>: DATABASE ENTRY DATE: 2019-04-01
  ref <313>: RELEVANT RESIDUES IN SEQ ID NO: (1)..(1511)
tcaaacttgagagtttgatcctggctcagaacgaacgctggcggcaagcctaacacatgcaagtcgaacggataactgcctatagcttttttgttataggcagttattagtggcagacgggtgagtaatgcataggaatctacctagtagtatggaatagccattagaaatgatgggtaatactgtataatccctgcgggggaaagatttatcgctattagatgagcctatgttagattagttagttggtaaggtaatggcttaccaagactatgatctatagctggtctgagaggacgatcagccacactggaactgagatacggtccagactcctacgggaggcagcagtggggaatattggacaatgggcgaaagcctgatccagctatgccgcgtgagtgaagaaggccttcgggttgtaaagctctttcaatagggaagataatgacggtacctatagaagaagtcccggcaaactctgtgccagcagccgcggtaatacggagggggcaagcgttgttcggaattattgggcgtaaagggcacgtaggtggactagtaagttaaaagtgaaataccagagcttaactttggagcggcttttaatactgctagactagaggtcgaaagaggatagcggaattcctagtgtagaggtgaaattcgtagatattaggaggaacaccagtggcgaaagcggctgtctggttcgatactgacactgaggtgcgaaagcgtggggagcaaacaggattagataccctggtagtccacgctgtaaacgatgagtgctaaatgtgaggattttatctttgtattgtagctaacgcgttaagcactccgcctggggactacggtcgcaagactaaaactcaaaggaattgacggggacccgcacaagcggtggagcatgtggtttaattcgatgcaacgcgaaaaaccttaccactttttgacatgaaggtcgtatcccccctaacagggggagtcagttcggctggaccttacacaggtgctgcatggctgtcgtcagctcgtgtcgtgagatgttgggttaagtcccgcaacgagcgcaaccctcgtccttagttaccaacaggtaatgctgggcactctaaggaaactgccagtgataaactggaggaaggtggggatgatgtcaagtcagcacggcccttataaggtgggctacacacgtgctacaatggcaactacaataggtcgcgagaccgcaaggtttagctaatccataaaagttgtctcagttcggattgttctctgcaactcgagagcatgaagtcggaatcgctagtaatcgtggatcatcatgccacggtgaatacgttctcgggtcttgtacacactgcccgtcacgccatgggaattggcttaactcgaagctggtgtgctaaccgaaaggaagcagccatttaaggttgggttagtgactagggtgaagtcgtaacaaggtagctgtaggtgaacctgcggctggattacctcctttt

SEQ ID NO: 3397 - DNA, 1512 bp, Ehrlichia sp. HF
  ref <308>: DATABASE ACCESSION NUMBER: NCBI ACCESSION: NZ_CP007474.1
  ref <309>: DATABASE ENTRY DATE: 2019-04-01
  ref <313>: RELEVANT RESIDUES IN SEQ ID NO: (1)..(1512)
tcaaacttgagagtttgatcctggctcagaacgaacgctggcggcaagcctaacacatgcaagtcgaacggacaattacctatagcctttttggttataggtagttgttagtggcagacgggtgagtaatgcataggaatctacctagtagtatggaatagccattagaaatgatgggtaatactgtataatccctgcgggggaaagatttatcgctattagatgagcctatgttagattagctagttggtaaggtaatggcttaccaaggctatgatctatagctggtctgagaggacgatcagccacactggaactgagatacggtccagactcctacgggaggcagcagtggggaatattggacaatgggcgaaagcctgatccagctatgccgcgtgagtgaagaaggccttcgggttgtaaagctctttcaatagggaagataatgacggtacctatagaagaagtcccggcaaactccgtgccagcagccgcggtaatacggagggggcaagcgttgttcggaattattgggcgtaaagggcacgtaggtggactagtaagttaaaagtgaaataccaaagcttaactttggagcggcttttaatactgctagactagaggtcgaaagaggatagcggaattcctagtgtagaggtgaaattcgtagatattaggaggaacaccagtggcgaaagcggctatctggttcgatactgacactgaggtgcgaaagcgtggggagcaaacaggattagataccctggtagtccacgctgtaaacgatgagtgctaaatgtgaggattttatctttgtattgtagctaacgcgttaagcactccgcctggggactacggtcgcaagactaaaactcaaaggaattgacggggacccgcacaagcggtggagcatgtggtttaattcgatgcaacgcgaaaaaccttaccactttttgacatgaaggtcgtatcccccctaacagggggagtcagttcggctggaccttacacaggtgctgcatggctgtcgtcagctcgtgtcgtgagatgttgggttaagtcccgcaacgagcgcaaccctcatccttagttaccaacaggtaatgctgggcactctaaggaaactgccagtgataaactggaggaaggtggggatgatgtcaagtcagcacggcccttataaggtgggctacacacgtgctacaatggcaactacaataggtcgcgaggccgcaaggtttagctaatccataaaagttgtctcagttcggattgttctctgcaactcgagagcatgaagtcggaatcgctagtaatcgtggatcatcatgccacggtgaatacgttctcgggtcttgtacacactgcccgtcatgccctgggaattggcttaactcgaagctggtgtgctaaccgaaaggaagcagccatttaaggttgggttggtgactatggtgaagtcgtaacaaggtagctgtaggtgaacctgcggctggattacctcctttt

SEQ ID NO: 3398 - DNA, 1511 bp, Ehrlichia sp. Wisconsin h; identical to SEQ ID NO: 3396
  ref <308>: DATABASE ACCESSION NUMBER: NCBI ACCESSION: NZ_JHOH01000004.1
  ref <309>: DATABASE ENTRY DATE: 2019-04-01
  ref <313>: RELEVANT RESIDUES IN SEQ ID NO: (1)..(1511)

SEQ ID NO: 3399 - DNA, 1520 bp, Eilatimonas milleporae
  ref <308>: DATABASE ACCESSION NUMBER: NCBI ACCESSION: NZ_REFR01000005.1
  ref <309>: DATABASE ENTRY DATE: 2019-04-01
  ref <313>: RELEVANT RESIDUES IN SEQ ID NO: (1)..(1520)
tcaacttgagagtttgatcctggctcagaacgaacgctggcggcacgcctaacacatgcaagtcgaacgcgaacgccctttcgggggttattagagtggcggacgggtgagtaacgcgtgggaacctgccctttggtacggaacaacgcctggaaacgggtgctaataccgtatacgcccaccttgattggtttcttggtggggaaagatttatcgccgaaggattggcccgcgttagattagctagttggtgaggtaagagctcaccaaggcgacgatctatagctggtttgagaggatgatcagccacactgggactgagacacggcccagactcctacgggaggcagcagtggggaatattggacaatgggggcaaccctgatccagcgatgccgcgtgagtgatgaaggccttagggttgtaaaactctttcaggggtgacgataatgacggtaaccccagaagaagctccggctaactccgtgccagcagccgcggtaatacggagggagctagcgttgttcggaatgactgggcgtaaagcgcgcgtaggcggatagacaagttgggggtgaaagcccggggctcaaccccggaactgccctcaaaactgtctgtctagaatcctggagaggtgagcggaattcctagtgtagaggtgaaattcgtagatattaggaagaacaccagtggcgaaggcggctcactggccaggtattgacgctgaggtgcgaaagcgtggggagcgaacaggattagataccctggtagtccacgccgtaaacgatgggtgctaggtgtcgggcagcatgctgttcggtgccgcagctaacgcgttaagcaccccgcctggggagtacggtcgcaagattaaaactcaaaggaattgacgggggcccgcacaagcggtggagcatgtggtttaattcgaagcaacgcgcagaaccttaccagcccttgacataccggtttgggtctttggagacagagactttcagttcggctggaccggatacaggtgctgcatggctgtcgtcagctcgtgtcgtgagatgttgggttaagtcccgcaacgagcgcaacccccatccttagttgccagcggtttggccgggcactctaaggaaactgccggtgataagccggaggaaggtggggatgacgtcaagtcctcatggcccttatgggctgggctacacacgtgctacaatggcggtgacagagggcagcgacccagcgatggggagcgaatctcaaaaaaccgtctcagttcggattgcactctgcaactcgggtgcatgaaggtggaatcgctagtaatcgcagatcagcatgctgcggtgaatacgttcccgggccttgtacacaccgcccgtcacaccatgggagttggttctacccgaagctggtgagctaaccttttggaggcagccaaccacggtaggattagcgactggggtgaagtcgtaacaaggtagccgtaggggaacctgcggctggatcacctcctttctaag

SEQ ID NO: 3400 - DNA, 1540 bp, Eisenbergiella massiliensis
  ref <308>: DATABASE ACCESSION NUMBER: NCBI ACCESSION: NZ_LT969517.1
  ref <309>: DATABASE ENTRY DATE: 2019-04-01
  ref <313>: RELEVANT RESIDUES IN SEQ ID NO: (1)..(1540)
ttaaacaagagagtttgatcctggctcaggatgaacgctggcggcgtgcctaacacatgcaagtcgaacgaagttatgcagaggaagttttcggatggaatcggcgtaacttagtggcggacgggtgagtaacgcgtgggaaacctgccctgtaccgggggataacacttagaaataggtgctaataccgcataagcgcacagcttcacatgaagcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttaaccagatttactgggtataaagggagcgtagacggcatgacaagcaagatgtgaaaacccagggctcaaacctggaactgaatgtggaactgccaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataggcaatccacctggggagtacgttcgcaagaatgaaactcaaaggaattgacgggggctagcacgagtggtggagcatgtggtttagttagaagcaacgcgaagtactctacttggtcttgtcgtcccaatgacgtgtcggaaatgggccattcttttgggagtactggtgatcggtggtgcatggttgtcgtcatctcgtgtcgtgagatgttgggttaagtcccgcaacgagcgcaacccttatccttagtagccagcaggtaaagctgggcactctagggagactgccggggataacccggaggaaggcggggatgacgtcaaatcatcatgccccttatgatttgggctacacacgtgctacaatggcgtaaacaaagggaagcgagacagtgatgttgagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagcctgtgacctaaccgcaagggaggagcagtcgaaggcaggtctaataactggggtgaagtcgtaacaaggtagccgtatcggaaggtgcggctggatcacctcctttctaagg

SEQ ID NO: 3401 - DNA, 1538 bp, Eisenbergiella sp. OF01-20
  ref <308>: DATABASE ACCESSION NUMBER: NCBI ACCESSION: NZ_QUES01000083.1
  ref <309>: DATABASE ENTRY DATE: 2019-04-01
  ref <313>: RELEVANT RESIDUES IN SEQ ID NO: (1)..(1538)
gaacaagagagtttgatcctggctcaggatgaacgctggcggcgtgcctaacacatgcaagtcgaacgaagttatgcagaggaagttttcggatggaatcggtgtaacttagtggcggacgggtgagtaacgcgtgggaaacctgccctgtaccgggggataacacttagaaataggtgctaataccgcataagcgcacagcttcacatgaggcagtgtgaaaaactccggtggtacaggatggtcccgcgtctgattagccagttggcagggtaacggcctaccaaagcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcatggcaagccagatgtgaaaacccagggctcaaccctgggactgcatttggaactgtcaggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgcggtaaacgatgattgctaggtgtaggtgggtatggacccatcggtgccgcagctaacgcaataagcaatccacctggggagtacgttcgcaagaatgaaactcaaaggaattgacggggacccgcacaagcggtggagcatgtggtttaattcgaagcaacgcgaagaaccttaccaagtcttgacatccccctgaatatcatgtaaaagtgataggccttcgggacaggggagacaggtggtgcatggttgtcgtcagctcgtgtcgtgagatgttgggttaagtcccgcaacgagcgcaacccttatccttagtagccagcaggtaaagccgggcactctagggagactgccggggataacccggaggaaggcggggatgacgtcaaatcatcatgccccttatgatttgggctacacacgtgctacaatggcgtaaacaaagggaagcgagacagtgatgtggagcaaatcccagaaataacgtctcagttcggattgtagtctgcaactcgactacatgaagctggaatcgctagtaatcgcgaatcagcatgtcgcggtgaatacgttcccgggtcttgtacacaccgcccgtcacaccatgggagttggaaatgcccgaagtctgtgacctaaccgaaagggaggagcagccgaaggcaggtctgataactggggtgaagtcgtaacaaggtagccgtatcggaaggtgcggctggatcacctcctttctaagg

SEQ ID NO: 3402 - DNA, 1224 bp, Eisenibacter elegans
  ref <308>: DATABASE ACCESSION NUMBER: NCBI ACCESSION: NZ_AUMD01000008.1
  ref <309>: DATABASE ENTRY DATE: 2019-04-01
  ref <313>: RELEVANT RESIDUES IN SEQ ID NO: (1)..(1224)
tttactatggagagtttgatcctggctcaggatgaacgctagcggcaggcctaacacatgcaagtcgaacgaagtagcaatacttagtggcgcacgggtgcgtaacgcgtaggcaatctacctcttactggggaataacttggggaaactcaagctaataccgcgtaacaagttgactggcatcagttgattttaaaagcttcggcggtaagagatgagcctgcgtcccattagctagttggtgtaggtaacggctcaccaaggcgacgatgggtaggggaactgagaggttgatcccccacactggtactgagatacggaccagactcctacgggaggcagcagtgaggaatattgggcaatggacgagagtctgacccagccatgccgcgtgcaggatgaaggccctctgggttgtaaactgcttttctacgggaagaaaaagctcttgcgggagtaattgacggtaccgtaggaataagcaccggctaactacgtgccagcagccgcggtaatacgtagggtgcaagcgttgtccggatttactgggtttaaagggtgcgtaggcggctatataagtcgtgggtgaaatcccggagcttaacttcggaactgcctgcgatactgtgtagcttgagtgcggtagaggaaggcggaattggtggtgtagcggtgaaatgcatagataccatcaggaacaccgatagcgaaggcagctttcttggccgcaactgacgctgaggcacgaaagcgtggggagcaaacaggattagataccctggtagtccacgctgtaaacgatgataactcgttgttggcgatacacagtcagtgactaagggaaaccgataagttatccacctggggagtacgcacgcaagtgtgaaactcaaaggaattgacgggggtccgcacaagcggtggagcatgtggtttaattcgatgatacgcgaggaaccttacctaggctagaatgtgcgtgaaggtattggagacaatgccgtccttcgggacacaaaacaaggtgctgcatggctgtcgtcagctcgtgccgtgaggtgttgggttaagtcccgcaacgagcgcaacccctattgttagttgccatcaggtaaagctggggactctaacaagactgcctgcgcaagcagagaggaaggtggggacgacgtcaagtcatcatggcccttacgcctagggcgacacacgtgctacaatggcagg

SEQ ID NO: 3403 - DNA, 1496 bp, Elioraea tepidiphila
  ref <308>: DATABASE ACCESSION NUMBER: NCBI ACCESSION: NZ_KB899943.1
  ref <309>: DATABASE ENTRY DATE: 2019-04-01
  ref <313>: RELEVANT RESIDUES IN SEQ ID NO: (1)..(1496)
atgaacctgagagtttgatcctggctcagagcgaacgctggcggcaggcttaacacatgcaagtcgtgcgccccgcaaggggagcggcggacgggtgagtaacgcgtgggaatgtgtcctcgggtgggggataaccctgggaaactagggctaataccgcatgatgtctgcggaccaaagccgcaaggcgcccgaggagcagcccgcgtccgattagctagttggtggggtaacggcctaccaaggcgacgatcggtagctggtctgagaggatgatcagccacactgggactgagacacggcccagactcctacgggaggcagcagtggggaatattggacaatgggcgaaagcctgatccagccatgccgcgtgggtgaagaaggccctagggttgtaaagccctttcggcggggacgatgatgacggtacccgcagaagaagccccggctaacttcgtgccagcagccgcggtaatacgaagggggctagcgttgctcggaattactgggcgtaaagggcgcgtaggcggccatatcagtcaggtgtgaaacccctgggctcaacctaggaactgcacttgagacggtatggcttgaggtcgagagaggatggtggaactcccagtgtagaggtgaaattcgtagatattgggaagaacaccggtggcgaaggcggccatctggctcgatcctgacgctgaggcgcgaaagcgtggggagcaaacaggattagataccctggtagtccacgctgtaaacgatgtgcgctggatgttggccgacctagtcggtcagtgtcgaagctaacgcgataagcgcaccgcctggggagtacggccgcaaggttgaaactcaaaggaattgacgggggcccgcacaagcggtggagcatgtggtttaattcgaagcaacgcgcagaaccttaccagcccttgacatgggcgcgacgggtcgagagatcggcctttggggaaactcacgcgccacacaggtgctgcatggctgtcgtcagctcgtgtcgtgagatgttgggttaagtcccgcaacgagcgcaaccctcgccttcagttgccagcgcgtttgggtgggcactctgaaggaactgccggtgacaagccggaggaaggtggggatgacgtcaagtcctcatggcccttatgggctgggctacacacgtgctacaatggcggtgacagtgggatgcaagccagtgatggtgagccaatcccaaaaagccgtctcagttcagattgcactctgcaactcgggtgcatgaaggcggaatcgctagtaatcgcggatcagcatgccgcggtgaatacgttcccgggccttgtacacaccgcccgtcacaccatgggagttggctttaccttaagccggtgcgctaaccgcaaggaggcagccgaccacggtaaggtcagcgactggggtgaagtcgtaacaaggtagccgtaggggaacctgcggctggatcacctcctttcaaggaa

SEQ ID NO: 3404 - DNA, 1522 bp, Elizabethkingia anophelis
  ref <308>: DATABASE ACCESSION NUMBER: NCBI ACCESSION: NZ_FTRB01000021.1
  ref <309>: DATABASE ENTRY DATE: 2019-04-01
  ref <313>: RELEVANT RESIDUES IN SEQ ID NO: (1)..(1522)
tacaatggagagtttgatcctggctcaggatgaacgctagcgggaggcctaacacatgcaagccgagcggtagattactttcgggtaattgagagcggcgtacgggtgcggaacacgtgtgcaacctgcctttatcagggggatagcctttcgaaaggaagattaataccccataatatattattcggcatcgggtgatattgaaaactacggtggatagagatgggcacgcgcaagattagctagttggtgaggtaacggctcaccaaggcgacgatctttagggggcctgagagggtgatcccccacactggtactgagacacggaccagactcctacgggaggcagcagtgaggaatattggacaatgggtgaaagcctgatccagccatcccgcgtgcaggaagacggccctatgggttgtaaactgcttttatctggggataaacctacttacgtgtaagtagctgaaggtaccagaagaataagcaccggctaactccgtgccagcagccgcggtaatacggagggtgcaagcgttatccggatttattgggtttaaagggtccgtaggcggactgataagtcagtggtgaaatccgacagcttaactgtcgaactgccattgatactgttagtcttgagtaaggttgaagtggctggaataagtagtgtagcggtgaaatgcatagatattacttagaacaccaattgcgaaggcaggtcactaagtcttaactgacgctgatggacgaaagcgtggggagcgaacaggattagataccctggtagtccacgccgtaaacgatgattactcgtttttgggtttaatgattcagagactaagcgaaagtgataagtaatccacctggggagtacgttcgcaagaatgaaactcaaaggaattgacgggggcccgcacaagcggtggagcatgtggtttaattcgatgatacgcgaggaaccttaccaagacttaaatgggaattgacagacgcagaaatgtgtttttcttcggacaattttcaaggtgctgcatggttgtcgtcagctcgtgccgtgaggtgttaggttaagtcctgcaacgagcgcaacccctgtcactagttgctaacattaagttgaggactctagtgagactgcctacgcaagtagagaggaaggtggggatgacgtcaaatcatcacggcccttacgtcttgggccacacacgtgctacaatggccggtacagagggcagctacctagtgataggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagctgggggtacctgaagtcggtgaccgtaaaaggagctgcctagggtaaaactagtaactagggctaagtcgtaacaaggtagccgtaccggaaggtgcggctggaacatctcattttaga

SEQ ID NO: 3405 - DNA, 1521 bp, Elizabethkingia meningoseptica
  ref <308>: DATABASE ACCESSION NUMBER: NCBI ACCESSION: NZ_LS483376.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcggaatcttgagagcggcgtacgggtgcggaacacgtgtgcaacctgcctttatcagggggatagcctttcgaaaggaagattaataccccataatatattaactggcatcagtgaatattgaaaactacggtggatagagatgggcacgcgcaagattagctagttggtgaggtaacggctcaccaaggcgacgatctttagggggcctgagagggtgatcccccacactggtactgagacacggaccagactcctacgggaggcagcagtgaggaatattggacaatgggtggaagcctgatccagccatcccgcgtgcaggaagacggccctatgggttgtaaactgcttttatctggggataaacctacttacgtgtaagtagctgaaggtaccagaagaataagcaccggctaactccgtgccagcagccgcggtaatacggagggtgcaagcgttatccggatttattgggtttaaagggtccgtaggcggactagtaagtcagtggtgaaatccgacagcttaactgtcgaactgccattgatactgctagtcttgagtaaggttgaagtggctggaataagtagtgtagcggtgaaatgcatagatattacttagaacaccaattgcgaaggcaggtcactaagtcttaactgacgctgatggacgaaagcgtggggagcgaacaggattagataccctggtagtccacgccgtaaacgatgattactcgtttttgggttttatgattcagagactaagcgaaagtgataagtaatccacctggggagtacgttcgcaagaatgaaactcaaaggaattgacgggggcccgcacaagcggtggagcatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattaagttgaggactctagtgagactgcctacgcaagtagagaggaaggtggggatgacgtcaaatcatcacggcccttacgtcttgggccacacacgtgctacaatggccggtacagagggcagctacctagcgataggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagctgggggtacctgaagtcggtgaccgtaaaaggagctgcctagggtaaaactagtaactagggctaagtcgtaacaaggtagccgtaccggaaggtgcggctggaacatctcattttaga

SEQ ID NO: 3406 - DNA, 1522 bp, Elizabethkingia miricola
  ref <308>: DATABASE ACCESSION NUMBER: NCBI ACCESSION: NZ_FTRC01000099.1
  ref <309>: DATABASE ENTRY DATE: 2019-04-01
  ref <313>: RELEVANT RESIDUES IN SEQ ID NO: (1)..(1522)
tacaatggagagtttgatcctggctcaggatgaacgctagcgggaggcctaacacatgcaagccgagcggtagagattcttcgggatcttgagagcggcgtacgggtgcggaacacgtgtgcaacctgcctttatcaaggggatagcctttcgaaaggaagattaataccctataatatatgattcggcatcggattatattgaaaactacggtggataaagatgggcacgcgcaagattagctagttggtgaggtaacggctcaccaaggcgacgatctttagggggcctgagagggtgatcccccacactggtactgagacacggaccagactcctacgggaggcagcagtgaggaatattggacaatgggtgaaagcctgatccagccatcccgcgtgtaggaagacggccctatgggttgtaaactacttttatctggggataaacctacttacgtgtaagtagctgaaggtaccagatgaataagcaccggctaactccgtgccagcagccgcggtaatacggagggtgcaagcgttatccggatttattgggtttaaagggtccgtaggcggactgataagtcagtggtgaaatccgacagcttaactgtcgaactgccattgatactgttagtcttgagtaaggttgaagtggctggaataagtagtgtagcggtgaaatgcatagatattacttagaacaccaattgcgaaggcaggtcactaagtcttaactgacgctgatggacgaaagcgtggggagcgaacaggattagataccctggtagtccacgccgtaaacgatgattactcgtttttgggttttaggattcagagactaagcgaaagtgataagtaatccacctggggagtacgttcgcaagaatgaaactcaaaggaattgacgggggcccgcacaagcggtggagcatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattaagttgaggactctagtgagactgcctacgcaagtagagaggaaggtggggatgacgtcaaatcatcacggcccttacgtcttgggccacacacgtgctacaatggccggtacagagggcagctacctagtgataggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagctgggggtacctgaagtcggtgaccgtaaaaggagctgcctagggtaaaactagtaactagggctaagtcgtaacaaggtagccgtaccggaaggtgcggctggaacatctcattttaga

SEQ ID NO: 3407 - DNA, 1521 bp, Elizabethkingia occulta
  ref <308>: DATABASE ACCESSION NUMBER: NCBI ACCESSION: NZ_MAHX01000009.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcggaatcttgagagcggcgtacgggtgcggaacacgtgtgcaacctgcctttatcaaggggatagcctttcgaaaggaagattaataccctataatatatgattcggcatcggattatattgaaaactacggtggataaagatgggcacgcgcaagattagctagttggtgaggtaacggctcaccaaggcgacgatctttagggggcctgagagggtgatcccccacactggtactgagacacggaccagactcctacgggaggcagcagtgaggaatattggacaatgggtgaaagcctgatccagccatcccgcgtgtaggaagacggccctatgggttgtaaactacttttatctggggataaacctacttacgtgtaagtagctgaaggtaccagatgaataagcaccggctaactccgtgccagcagccgcggtaatacggagggtgcaagcgttatccggatttattgggtttaaagggtccgtaggcggactgataagtcagtggtgaaatccgacagcttaactgtcgaactgccattgatactgttagtcttgagtaaggttgaagtggctggaataagtagtgtagcggtgaaatgcatagatattacttagaacaccaattgcgaaggcaggtcactaagtcttaactgacgctgatggacgaaagcgtggggagcgaacaggattagataccctggtagtccacgccgtaaacgatgattactcgtttttgggttttaggattcagagactaagcgaaagtgataagtaatccacctggggagtacgttcgcaagaatgaaactcaaaggaattgacgggggcccgcacaagcggtggagcatgtggtttaattcgatgatacgcgaggaaccttaccaagacttaaatgggaaatgacagctttagaaatagagttttcttcggacatttttcaaggtgctgcatggttgtcgtcagctcgtgccgtgaggtgttaggttaagtcctgcaacgagcgcaacccctgtcactagttgctaacattaagttgaggactctagtgagactgcctacgcaagtagagaggaaggtggggatgacgtcaaatcatcacggcccttacgtcttgggccacacacgtgctacaatggccggtacagagggcagctacctagtgataggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagctgggggtacctgaagtcggtgaccgtaacaggagctgcctagggtaaaactagtaactagggctaagtcgtaacaaggtagccgtaccggaaggtgcggctggaacatctcattttaga

SEQ ID NO: 3408 - DNA, 1521 bp, Elizabethkingia sp. YR191
  ref <308>: DATABASE ACCESSION NUMBER: NCBI ACCESSION: NZ_QAXV01000019.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcggaatcttgagagcggcgtacgggtgcggaacacgtgtgcaacctgcctttatcaaggggatagcctttcgaaaggaagattaataccctataatatattgactggcatcagttgatattgaaaactacggtggataaagatgggcacgcgcaagattagctagttggtgaggtaacggctcaccaaggcgacgatctttagggggcctgagagggtgatcccccacactggtactgagacacggaccagactcctacgggaggcagcagtgaggaatattggacaatgggtgcaagcctgatccagccatcccgcgtgtaggaagacggccctatgggttgtaaactacttttatctggggataaacctacttacgtgtaagtagctgaaggtaccagatgaataagcaccggctaactccgtgccagcagccgcggtaatacggagggtgcaagcgttatccggatttattgggtttaaagggtccgtaggcgggctgataagtcagtggtgaaatccgacagcttaactgtcgaactgccattgatactgtcagccttgagtaaggttgaagtggctggaataagtagtgtagcggtgaaatgcatagatattacttagaacaccaattgcgaaggcaggtcactaagtcttaactgacgctgatggacgaaagcgtggggagcgaacaggattagataccctggtagtccacgccgtaaacgatgattactcgtttttgggttttaggattcagagactaagcgaaagtgataagtaatccacctggggagtacgttcgcaagaatgaaactcaaaggaattgacgggggcccgcacaagcggtggagcatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattaagttgaggactctagtgagactgcctacgcaagtagagaggaaggtggggatgacgtcaaatcatcacggcccttacgtcttgggccacacacgtgctacaatggccggtacagagggcagctacctagtgataggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagctgggggtacctgaagtcggtgaccgtaaaaggagctgcctagggtaaaactagtaactagggctaagtcgtaacaaggtagccgtaccggaaggtgcggctggaacatctcattttaga

SEQ ID NO: 3409 - DNA, 1521 bp, Elizabethkingia sp. YR214; identical to SEQ ID NO: 3408
  ref <308>: DATABASE ACCESSION NUMBER: NCBI ACCESSION: NZ_QBUH01000017.1
  ref <309>: DATABASE ENTRY DATE: 2019-04-01
  ref <313>: RELEVANT RESIDUES IN SEQ ID NO: (1)..(1521)

SEQ ID NO: 3410 - DNA, 1521 bp, Elizabethkingia ursingii
  ref <308>: DATABASE ACCESSION NUMBER: NCBI ACCESSION: NZ_MAHB01000003.1
  ref <309>: DATABASE ENTRY DATE: 2019-04-01
  ref <313>: RELEVANT RESIDUES IN SEQ ID NO: (1)..(1521)
acaatggagagtttgatcctggctcaggatgaacgctagcgggaggcctaacacatgcaagccgagcggtagagattcttcggaatcttgagagcggcgtacgggtgcggaacacgtgtgcaacctgcctttatcaaggggatagcctttcgaaaggaagattaataccctataatatattgactggcatcagttaatattgaaaactacggtggataaagatgggcacgcgcaagattagctagttggtgaggtaacggctcaccaaggcgacgatctttagggggcctgagagggtgatcccccacactggtactgagacacggaccagactcctacgggaggcagcagtgaggaatattggacaatgggtgaaagcctgatccagccatcccgcgtgtaggaagacggccctatgggttgtaaactacttttatctggggataaacctacttacgtgtaagtagctgaaggtaccagatgaataagcaccggctaactccgtgccagcagccgcggtaatacggagggtgcaagcgttatccggatttattgggtttaaagggtccgtaggcggactgataagtcagtggtgaaatccgacagcttaactgtcgaactgccattgatactgttagtcttgagtaaggttgaagtggctggaataagtagtgtagcggtgaaatgcatagatattacttagaacaccaattgcgaaggcaggtcactaagtcttaactgacgctgatggacgaaagcgtggggagcgaacaggattagataccctggtagtccacgccgtaaacgatgattactcgtttttgggttttaggattcagagactaagcgaaagtgataagtaatccacctggggagtacgttcgcaagaatgaaactcaaaggaattgacgggggcccgcacaagcggtggagcatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattaagttgaggactctagtgagactgcctacgcaagtagagaggaaggtggggatgacgtcaaatcatcacggcccttacgtcttgggccacacacgtgctacaatggccggtacagagggcagctacctagtgataggatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagctgggggtacctgaagtcggtgaccgtaaaaggagctgcctagggtaaaactagtaactagggctaagtcgtaacaaggtagccgtaccggaaggtgcggctggaacatctcattttaga

SEQ ID NO: 3411 - DNA, 1499 bp, Elstera litoralis
  ref <308>: DATABASE ACCESSION NUMBER: NCBI ACCESSION: NZ_LAJY01000856.1
  ref <309>: DATABASE ENTRY DATE: 2019-04-01
  ref <313>: RELEVANT RESIDUES IN SEQ ID NO: (1)..(1499)
tcaacctgagagtttgatcctggctcagaacgaacgctggcggcatgcctaacacatgcaagtcgaacgagtaccttcgggtgctagtggcgcacgggtgagtaacgcgtgggaacctgccttatggtacgggataacgtcgggaaactgacgctaataccgtatatgtctttggatgaaagatttatcgccataagaggggcccgcgtctgattaggtagttggtgaggtaatggctcaccaagccttcgatcagtagctggtctgagaggatgatcagccacactgggactgagacacggcccagactcctacgggaggcagcagtggggaatattggacaatgggcgcaagcctgatccagcaatgccgcgtgagtgatgaaggccttcgggttgtaaagctcttttacctgcgacgatgatgacggtagcaggagaataagccccggctaacttcgtgccagcagccgcggtaatacgaagggggctagcgttgttcggaattactgggcgtaaagggcgcgtaggcggccctgtcagtcaagcgtgaaagccccgggctcaacctgggaattgcgcctgatactgcagggcttgagggtcggagaggatggtggaattcccagtgtagaggtgaaattcgtagatattgggaagaacaccggtggcgaaggcggccatctggacgacatctgacgctgaggcgcgaaagcgtggggagcaaacaggattagataccctggtagtccacgctgtaaacgatgaatgctagacgttggggttctcagaacttcagtgtcgccgctaacgcattaagcattccgcctggggagtacggtcgcaagattaaaactcaaaggaattgacgggggcccgcacaagcggtggagcatgtggtttaattcgaagcaacgcgcagaaccttaccagcccttgacatgggacctttggttaccggagacggtttccttcacttcgggtggggtccacacaggtgctgcatggctgtcgtcagctcgtgtcgtgagatgttgggttaagtcccgcaacgagcgcaaccctcatcgtcagttgccaccagttcggctgggcactctgacgaaaccgccggtgacaagccggaggaaggcggggatgacgtcaagtcctcatggcccttatgggctgggctacacacgtgctacaatggtggtgacagtgggacgcaaggtcgcgaggccaagcaaatctccaaaagccatctcagttcagattgcactctgcaactcgagtgcatgaaggcggaatcgctagtaatcgcggatcagcatgccgcggtgaatacgttcccgggccttgtacacaccgcccgtcacaccatgggagttggctttacccgaagccggtgcgctaactcgcaagagaggcagccgaccacggtagggtcagtgactggggtgaagtcgtaacaaggtagccgtaggggaacctgcggctggatcacctcctttctaagga

SEQ ID NO: 3412 - DNA, 1508 bp, Elusimicrobium minutum
  ref <308>: DATABASE ACCESSION NUMBER: NCBI ACCESSION: NC_010644.1
  ref <309>: DATABASE ENTRY DATE: 2019-04-01
  ref <313>: RELEVANT RESIDUES IN SEQ ID NO: (1)..(1508)
cggagagtttgatcctggctcagagttaacgctggcatcgtgcataacacatgcaagtcgaacgggaattttttgtgtagcaatacatgaaaaattctagtggcagacgggtgagtaatacataaggaatctaccttgaagtggggaacaactagtcgaaagattagctaatactccataatatcacttagtggcatcacttagtgattaaagatttatcgcttcaagacgatcttatggtctatcagctagttggtagggtaatggcctaccaaggcgacgacggatagccggcctgaaagggcgaccggccacaggggcactgagacacgggccccactcctacgggaggcagcagtggggaattttggacaatggacgcaagtctgatccagcaacgatgcgtggaggatgaaggttttcggattgtaaactccttttgcaggggaagaaaaaaatgacggtactctgcgaataagccacggctaactacgtgccagcagccgcggtaagacgtaggtggcaagcgttactcggaattactaggcgtaaagcgcgcgtaggcggattgttaagtctgttgtgtaatctctgggcccaacccagaaactgcaattgaaactggcgatcttgagtgaggcagaggaaatcggaattccaagtgtagcagtgaaatgcgtagatatttggaggaacaccggtggcgaaggcggatttctgggcctttactgacgctgaagtgcgaaagctaggggagcaaacgggattagataccccggtagtcctagccgtaaacgatgataactaggtgtgggaggtatcgaccccttccgtgccgacgctaacgcattaagttatccgcctggggagtacggccgcaaggttaaaactcaaaggaattgacggggacccgcacaagaggtggattatgtggtttaattcgacgctacgcgaaaaaccttacctgggctcgaacgactggtagtaacatttatgaaagtagatgtgattcgcaagaaagccagccgaggtgctgcatggttgtcgtcagctcgtgtcgtgagatgttgggttaagtcccgcaacgagcgcaacccctattctgtgttgcctagcaataggatctctcagaagactgccgcggataacgtggaggaaggtggggatgacgtcaaatcatcatggcctttatgtccagggctacacacgtaatacaatggcatagacagagggcagcaatatcgcgagatggagccaatccctaaactatgccccagttcagattgcaggctgcaattcgcctgcatgaagccggaatctctagtaatcgcagatcagcacgctgcggtgaatacgttcccgggtcttgtacacaccgcccgtcacaccacgaaagttaattgcaacagaagtgctcaggtcgtctgggccctaagttgtgattagtaattggggtgaagtcgtaacaaggtagccgtaccggaaggtgcggctggatcacctccttt

SEQ ID NO: 3413 - DNA, 1508 bp, Emcibacter congregatus
  ref <308>: DATABASE ACCESSION NUMBER: NCBI ACCESSION: NZ_PDEM01000030.1
  ref <309>: DATABASE ENTRY DATE: 2019-04-01
  ref <313>: RELEVANT RESIDUES IN SEQ ID NO: (1)..(1508)
caacttgagagtttgatcctggctcagaacgaacgctggcggcatgcctaacacatgcaagtcgaacgataaggtaccttcgggtactggacagtggcgcacgggtgagtaacacgtggggacctaccatatagtacggaacaaccgttggaaacgacggctaataccgtatacgctcttcggaggaaagatttatcgctatatgatggacccgcgctggattagatagttggtgaggtaatggctcaccaagtctgcgatccatagctggtttgagaagatgatcagccacattgggactgagacacggcccagactcctacgggaggcagcagtggggaatattgcacaatgggcgcaagcctgatgcagcaatgccgcgtgagtgaagacggccttagggttgtaaaactctttcgctagggaagataatgactgtacctagtaaagaagtcccggctaactccgtgccagcagccgcggtaatacggaggggactagcgttgttcggaattactgggcgtaaagagttcgtaggcggactggcaagtaagaggtgaaatcccagggctcaaccctggaactgccttttaaactgccaatctagagaccggaagaggttaggggaatacctagtgtagaggtgaaattcgtagatattaggtggaacaccagtggcgaaggcgcctaactggtccggtactgacgctgaggaacgaaagcgtggggagcaaacaggattagataccctggtagtccacgccgtaaacgatgagtgctagatgttgggatcttcggatttcagtgtcgcagctaacgcattaagcactccgcctggggagtacggccgcaaggttaaaactcaaaggaattgacgggggcccgcacaagcggtggagcatgtggtttaattcgaagcaacgcgaagaaccttaccagcccttgacataccgatcgcgatttccagagatggatatcttcagttaggctggatcggatacaggtgctgcacggctgtcgtcagctcgtgtcgtgagatgttaggttaagtcctgcaacgagcgcaacccctgcctttagttgccatcaggttatgctgggcactctagagggaccgccggtgataaaccggaggaaggtggggacgacgtcaagtcatcatggcccttatgggctgggctacacacgtgctacaatggcagatacagagggtcgccactccgcgaggaggcgctaatcccaaaaatctgtctcagttcggattgttctctgcaactcgagagcatgaagttggaatcgctagtaatcgtggatcagcatgccacggtgaatacgttcccgggccttgtacacaccgcccgtcacaccatgggagttggttttacccgaagccggtgggctaacctcgcaagaggaagcagccgaccacggtaagattagcgactggggtgaagtcgtaacaaggtagccgtaggggaacctgcggctggatcacctcctttctaagg

SEQ ID NO: 3414 - DNA, 1504 bp, Emticicia sp. 17J42-9
  ref <308>: DATABASE ACCESSION NUMBER: NCBI ACCESSION: NZ_SEWF01000030.1
  ref <309>: DATABASE ENTRY DATE: 2019-04-01
  ref <313>: RELEVANT RESIDUES IN SEQ ID NO: (1)..(1504)
tttacaatggagagtttgatcctggctcaggatgaacgctagcggcgggcttaatacatgcaagtcgaggggtagcaatacaccggcgcacgggtgcgtaacgcgtatgcaacctacctgtatcagggggatagcccggggaaacccggattaataccgcataagtaagtagattggcatcaatcagctttgaaagatttatcggatacagatgggcatgcgtaagattagatagttggcgaggtaacggctcaccaagtctacgatctttaggggctctgagaggagaatcccccacactggcactgagatacgggccagactcctacgggaggcagcagtagggaatattgggcaatggacgcaagtctgacccagccacgccgcgtgcaggaagaaggccctctgggttgtaaactgcttttgactgggaagaaaagatctcttgcgagagaagttgacggtaccagtggaataagccacggctaactacgtgccagcagccgcggtaatacgtaggtggcgagcgttatccggatttattgggtttaaagggtgcgtaggcggctgattaagtcagcggtgaaaggtagcagcttaactgttttacatgccgttgatactggttagcttgagttaacagaaggcagatagaatttctggtgtagcggtgaaatgcttagataccaggaggaataccgattgcgaaggcagtctgctgcagttacactgacgctgaggcacgaaagtgcggggatcaaacaggattagataccctggtagtccgcacagtaaacgatgattactagttgttggcgcaagtcagtgaccaagggaaaccgataagtaatccacctggggagtacgccggcaacggtgaaactcaaaggaattgacgggggtccgcacaagcggtggagcatgtggtttaattcgatgatacgcgaggaaccttacctggactagaatgtgagggaattattcagaaatggataagccagcaatggcccaaaacaaggtgctgcatggctgtcgtcagttcgtgccgtgaggtgttgggttaagtcccgcaacgaacgcaacccctgttgtctgttgccatcaagttaagttggggactcagacaagactgcctacgcaagtagagaggaaggaggggacgacgtcaagtcatcatggcccttacgtccagggcaacacacgtgctacaatgggcgatacagagtgttgcgagccagcaatggcaagccaatcacaaaaagtcgttcacagttcggattggggtctgcaactcgaccctatgaagctggaatcgctagtaatcgggtatcagctatgacccggtgaatacgttcccggaccttgtacacaccgcccgtcaagccatggaagttgggtagacctgaagcggaaggtaaaagatttcgttagggtagaaccagtaactggggctaagtcgtaacaaggtagccgtaccggaaggtgcggctggaacacctccttt

SEQ ID NO: 3415 - DNA, 1505 bp, Emticicia sp. C21
  ref <308>: DATABASE ACCESSION NUMBER: NCBI ACCESSION: NZ_QVMT01000028.1
  ref <309>: DATABASE ENTRY DATE: 2019-04-01
  ref <313>: RELEVANT RESIDUES IN SEQ ID NO: (1)..(1505)
tttacaatggagagtttgatcctggctcaggatgaacgctagcggcgggcttaatacatgcaagtcgaggggtagcaatacaccggcgcacgggtgcgtaacgcgtatgcaacctacctttatctgggggatagcccggggaaacccggattaataccgcataagtaagtaacttggcatcaagtagctttgaaagatttatcggataaagatgggcatgcgtaagattagatagttggcggggtaacggctcaccaagtctacgatctttaggggctctgagaggagaatcccccacactggcactgagatacgggccagactcctacgggaggcagcagtagggaatattgggcaatggacgcaagtctgacccagccacgccgcgtgcaggaagaaggccctctgggttgtaaactgcttttgactgggaagaaaagatctcttgcgagagaagttgacggtaccagcagaataagccacggctaactacgtgccagcagccgcggtaatacgtaggtggcgagcgttatccggatttattgggtttaaagggtgcgtaggcggctgattaagtcagcggtgaaaggtagcagcttaactgttttacatgccgttgatactggttagcttgagttaacagaaggcagatagaatttctggtgtagcggtgaaatgcttagataccaggaggaataccgattgcgaaggcagtctgctgcagttacactgacgctgaggcacgaaagtgcggggatcaaacaggattagataccctggtagtccgcacagtaaacgatgattactagttgttggcgaatagtcagtgaccaagggaaaccgataagtaatccacctggggagtacgccggcaacggtgaaactcaaaggaattgacgggggtccgcacaagcggtggagcatgtggtttaattcgatgatacgcgaggaaccttacctggactagaatgtgagggaagaattcagaaatggattcgccagcaatggcccaaaacaaggtgctgcatggctgtcgtcagttcgtgccgtgaggtgttgggttaagtcccgcaacgaacgcaacccctgttgtctgttgccatcaagtaaagttggggactcagacaagactgcctacgcaagtagagaggaaggaggggacgacgtcaagtcatcatggcccttacgtccagggcaacacacgtgctacaatgggcgatacagagtgttgcgagccagcaatggcaagccaatcacaaaaagtcgttcacagttcggattggggtctgcaactcgaccctatgaagctggaatcgctagtaatcggatatcagctatgatccggtgaatacgttcccggaccttgtacacaccgcccgtcaagccatggaagttgggtagacctgaagcggaaggtaaaagatttcgttagggtagaaccagtaactggggctaagtcgtaacaaggtagccgtaccggaaggtgcggctggaacacctccttt

SEQ ID NO: 3416 - DNA, 1509 bp, Emticicia sp. TH156
  ref <308>: DATABASE ACCESSION NUMBER: NCBI ACCESSION: NZ_PKRS01000024.1
  ref <309>: DATABASE ENTRY DATE: 2019-04-01
  ref <313>: RELEVANT RESIDUES IN SEQ ID NO: (1)..(1509)
tttacaatggagagtttgatcctggctcaggatgaacgctagcggcgggcttaatacatgcaagtcgaggggtggtagcaatactacaccggcgcacgggtgcgtaacgcgtatgcaatctacctttatctgggggatagcccggggaaacccggattaataccgcataacaaatttcttggcatcaagagattttaaaagatttatcggatagagatgagcatgcgtaagattagatagttggcgaggtaacggctcaccaagtctacgatctttaggggctctgagaggagaatcccccacactggcactgagatacgggccagactcctacgggaggcagcagtagggaatattgggcaatgggcgcaagcctgacccagccacgccgcgtgcaggaagaaggccctctgggttgtaaactgcttttgaccgggaagaaaagaacctttgcgaagggagttgacggtaccggcagaataagccacggctaactacgtgccagcagccgcggtaatacgtaggtggcgagcgttatccggatttattgggtttaaagggtgcgtaggcggctgattaagtcagcggtgaaaggtagcagcttaactgttttacatgccgttgatactggttagcttgagttaacagaaggcagatagaatttctggtgtagcggtgaaatgcttagataccagaaggaataccgattgcgaaggcagtctgctgcagttacactgacgctgaggcacgaaagtgcggggatcaaacaggattagataccctggtagtccgcacagtaaacgatgattactagttgttggcgagagtcagtgaccaagggaaaccgataagtaatccacctggggagtacgccggcaacggtgaaactcaaaggaattgacgggggtccgcacaagcggtggagcatgtggtttaattcgatgatacgcgaggaaccttacctggactagaatgtgagggaattattcagaaatggataagccagcaatggcccgaaacaaggtgctgcatggctgtcgtcagttcgtgccgtgaggtgttgggttaagtcccgcaacgaacgcaacccctgttgtctgttgccatcaagtaaagttggggactcagacaagactgcctacgcaagtagagaggaaggaggggacgacgtcaagtcatcatggcccttacgtccagggcaacacacgtgctacaatgggcgatacagagtgttgcgagccagcaatggcaagccaatcacaaaaagtcgttcacagttcggattggggtctgcaactcgaccctatgaagctggaatcgctagtaatcggatatcagctatgatccggtgaatacgttcccggaccttgtacacaccgcccgtcaagccatggaagttgggtagacctgaagcggaaggtaaaagatttcgttagggtagaaccagtaactggggctaagtcgtaacaaggtagccgtaccggaaggtgcggctggaacacctccttt

SEQ ID NO: 3417 - DNA, 1479 bp, Endozoicomonadaceae bacterium GTF-13
  ref <308>: DATABASE ACCESSION NUMBER: NCBI ACCESSION: NZ_SBHR01000005.1
  ref <309>: DATABASE ENTRY DATE: 2019-04-01
  ref <313>: RELEVANT RESIDUES IN SEQ ID NO: (1)..(1479)
gcggaaacgatgatagcttgctatcaggcgtcgagcggcggacgggtgagtaacgcgtgggaatctacctagtagtgggggatagcccggagaaattcggattaataccgcatacaccctacggggaaaagggggcctcttcttgaaagctctcgctattggatgagcccgcgtcggattagctagttggtagggtaaaggcctaccaaggcgacgatccgtagctggtctgagaggatgatcagccacactgggactgagacacggcccagactcctacgggaggcagcagtggggaatattgcacaatgggcgaaagcctgatgcagccatgccgcgtgtgtgaagaaggccttagggttgtaaagcactttcagttgggaggaaaggttgtaggttaataccctgcagctgtgacgttaccaacagaagaagcaccggctaactccgtgccagcagccgcggtaatacggagggtgcaagcgttaatcggaattactgggcgtaaagcgtgcgtaggcggtttgttaagtgggatgtgaaagccccgggctcaacctgggaactgcatcccgaactgattgactagagtgcggtagaggggagtggaatttcctgtgtagcggtgaaatgcgtagatataggaaggaacaccagtggcgaaggcgactccctggactgacactgacgctgaggtacgaaagcgtggggagcaaacaggattagataccctggtagtccacgccgtaaacgatgagaactagccgttggggagcttgactctttagtggcgcagctaacgcaataagttctccgcctggggagtacggtcgcaagattaaaactcaaatgaattgacgggggcccgcacaagcggtggagcatgtggtttaattcgaagcaacgcgaagaaccttacctggtcttgacatcctcagaactttccagagatggattggtgccttcgggaactgagtgacaggtgctgcatggctgtcgtcagctcgtgtcgtgagatgttgggttaagtcccgtaacgagcgcaacccttgtccttatttgccagcacgtaatggtgggaactttaaggagactgccggtgacaaaccggaggaaggtggggacgacgtcaagtcatcatggcccttacgaccagggctacacacgtgctacaatggagcgtacaaagggttgccaagccgcgaggtggagctaatcccataaaacgtttcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccctaggggaacctggggctggatcacctccttaa

SEQ ID NO: 3418 - DNA, 1584 bp, Endozoicomonas ascidiicola
  ref <308>: DATABASE ACCESSION NUMBER: NCBI ACCESSION: NZ_LUTW01000003.1
  ref <309>: DATABASE ENTRY DATE: 2019-04-01
  ref <313>: RELEVANT RESIDUES IN SEQ ID NO: (1)..(1584)
aaactgaagagtttgatcatggctcagattgaacgctggcggcaggcctaacacatgcaagtcgagcggtaacagggaaagcttgctttctgctgacgagcggcggacgggtgcgtaacacgtaggaatctgcctggtagtgggggatagcccggagaaatccggattaataccgcatacgccctaagggggaaaggaggggacccatttcttttattaggagtgagcctttcgctatcagatgagcctgcgtcggattagcttgttggtggggtaaaggcctaccaaggcgacgatccgtagctggtctgagaggatgatcagccacactgggactgagacacggcccagactcctacgggaggcagcagtggggaatattgcacaatgggcgaaagcctgatgcagccatgccgcgtgtgtgaagaaggccttagggttgtaaagcactttcagcgaggaggaaagggttaaagttaatacctttaatctgtgacgttactcgcagaagaagcaccggctaactccgtgccagcagccgcggtaatacggagggtgcgagcgttaatcggaattactgggcgtaaagcgtgcgtaggcggctacttaagttggatgtgaaagcccygggctyaacctgggaactgcatccaaaactgrgtggctagagtgcgagagaggagtgtggaatttcctgtgtagcggtgaaatgcgtagatataggaaggaacaccagtggcgaaggcgacactctggcttgacactgacgctgaggtacgaaagcgtggggagcaaacaggattagataccctggtagtccacgccgtaaacgatgtctactagttgtccgttgtcttgtacgatgggtaacgmagctaacgcgataagtagaccgcctggggagtacggccgcaaggttaaaactcaaatgaattgacgggggcccgcacaagcggtggagcatgtggtttaattcgaagcaacgcgaagaaccttacctggccttgacatcctgcgaactttctagagatagattggtgccttcgggaacgcagagacaggtgctgcatggctgtcgtcagctcgtgtcgtgagatgttgggttaagtcccgcaacgagcgcaacccttgtccttagttaccagcacgttatggtgggcactctagggagactgccggtgacaaaccggaggaaggtggggacgacgtcaagtcatcatggcccttacggccagggctacacacgtgctacaatggtgcatacagacggttgccaagccgcgaggtggagctaatctgagaaagtgcatcgtagtccggattggagtctgcaactcgactccatgaagtcggaatcgctagtaatcgtgaatcagaatgtcacggtgaatacgttcccgggccttgtacacaccgcccgtcacaccatgggagtgggttgctccagaagtggctagcttaacctttgacagccttgagctgataaggagagcggtcaccacggagtgattcatgactggggtgaagtcgtaacaaggtagccctaggggaacctggggctggatcacctccttaaacgaaaac

SEQ ID NO: 3419 - DNA, 1500 bp, Enhydrobacter aerosaccus
  ref <308>: DATABASE ACCESSION NUMBER: NCBI ACCESSION: NZ_FUWJ01000012.1
  ref <309>: DATABASE ENTRY DATE: 2019-04-01
  ref <313>: RELEVANT RESIDUES IN SEQ ID NO: (1)..(1500)
ttaaacttgagagtttgatcctggctcagaacgaacgctggcggcaggcttaacacatgcaagtcgaacgcgtgtagcaatacacgagtggcgcacgggtgagtaacgcgtggatatctgccttttggttcggaataaccccgggaaactggggctaataccggatggttcctacgggataaagatttatcgccaaaagatgagtccgcgtccgattagctagttggtggggtaacggcctaccaaggcgacgatcggtagctggtctgagaggacgatcagccacactgggactgagacacggcccagactcctacgggaggcagcagtggggaatattggacaatgggggcaaccctgatccagccatgccgcgtgagtgatgaaggccttcgggttgtaaagctcttttggcggggacgatgatgacggtacccgcagaataagccccggctaacttcgtgccagcagccgcggtaagacgaagggggctagcgttgttcggaattactgggcgtaaagcgagtgtaggcggttgttatagtcaggtgtgaaagccttgagctcaactcaagaaatgcacttgatactgaacagctagagtaccggagaggatagtggaattcccagtgtagtggtgaaatacgtagagattgggaagaacaccagtggcgaaggcggctatctggacggttactgacgctaagactcgaaagcgtggggagcaaacaggattagataccctggtagtccacgccgtaaacgatgggtgctagacgttggcgagcttgctcgtcagtgtcgcagctaacgcgttaagcaccccgcctggggagtacggccgcaaggttgaaactcaaaggaattgacgggggcccgcacaagcggtggagcatgtggttcaattcgacgcaacgcgcagaaccttaccagcccttgacatgtgactcgccggctccagagacggagccttcggttcggccggagtcaacacaggtgctgcatggctgtcgtcagctcgtgtcgtgagatgttgggttaagtcccgcaacgagcgcaaccctcgtctccagttgccatcaggttatgctgggcactttggagaaactgccggtgacaagccggaggaaggtggggatgacgtcaagtcctcatggcccttacgggctgggctacacacgtgctacaatggcggtgacagtgggatgcgaaggggcgacccggagccgatcccaaaaagccgtcccagttcggattgcactctgcaactcgagtgcatgaaggtggaatcgctagtaatcgcggatcagcatgccgcggtgaatacgttcccgggccttgtacacaccgcccgtcacgccatgggagttggttctacccgaagatggtgcgctaaccgcaaggaggcagccagccacggtaggatcaatgactggggcgaagtcgtaacaaggtagccgtaggggaacctgcggctggatcacctcctttctaaggaag

SEQ ID NO: 3420 - DNA, 1491 bp, Ensifer adhaerens
  ref <308>: DATABASE ACCESSION NUMBER: NCBI ACCESSION: NZ_OCMG01000004.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgaacgccccgcaaggggagtggcagacgggtgagtaacgcgtgggaatctacccatccctacggaataacgcatggaaacgtgtgctaataccgtatacgccctacgggggaaagatttatcggggatggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccggagaagataatgacggtatccggagaagaagccccggctaacttcgtgccagcagccgcggtaatacgaagggggctagcgttgttcggaattactgggcgtaaagcgcacgtaggcggacttttaagtcaggggtgaaatcccagagctcaactctggaactgcctttgatactggaagtctggagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggattacagagatgttttccttcagttcggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 3421 - DNA, 1491 bp, Ensifer adhaerens
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtataagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacggagacgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 3422 - DNA, 1491 bp, Ensifer alkalisoli
  ref <308>: DATABASE ACCESSION NUMBER: NCBI ACCESSION: NZ_LYBW01000060.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgcgtagcaatacgagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatctagagtccagaagaggtgagtggaattccgagtgtagaggtgaaattcgtagatattcggaggaacaccagtggcgaaggcggctcactggtctggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggatacgagagatcgtattcttcagttcggctggaccggagacaggtgctgcatggctgtcgtcagctcgtgtcgtgagatgttgggttaagtcccgcaacgagcgcaaccctcgcccttagttgccagcattaagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgggtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 3423 - DNA, 1500 bp, Ensifer aridi
  ref <308>: DATABASE ACCESSION NUMBER: NCBI ACCESSION: NZ_LUFX01000119.1
  ref <309>: DATABASE ENTRY DATE: 2019-04-01
  ref <313>: RELEVANT RESIDUES IN SEQ ID NO: (1)..(1500)
ttgaattctcaacttgagagtttgatcctggctcagaacgaacgctggcggcaggcttaacacatgcaagtcgagcgcgtagcaatacgagcggcagacgggtgagtaacgcgtgggaatctacccttttctacggaataacgcagggaaacttgtgctaataccgtatacgcccttcgggggaaagatttatcggagaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtccggaagaggtgagtggaattccgagtgtagaggtgaaattcgtagatattcggaggaacaccagtggcgaaggcggctcactggtccggaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggatacgagagatcgtatccttcagttcggctggaccggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3424 - DNA, 1492 bp, Ensifer glycinis
  ref <308>: DATABASE ACCESSION NUMBER: NCBI ACCESSION: NZ_LPUX01000030.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgcgtggcaacacgagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcgggaacgagagatcgtttccttcagttcggctggaccggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3425 - DNA, 1321 bp, Ensifer sp. 1H6
  ref <308>: DATABASE ACCESSION NUMBER: NCBI ACCESSION: NZ_MOAI01000077.1
  ref <309>: DATABASE ENTRY DATE: 2019-04-01
  ref <313>: RELEVANT RESIDUES IN SEQ ID NO: (1)..(1321)
gggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacagagatgtattccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 3426 - DNA, 1491 bp, Ensifer sp. AP48; identical to SEQ ID NO: 3421
  ref <308>: DATABASE ACCESSION NUMBER: NCBI ACCESSION: NZ_QKLQ01000079.1
  ref <309>: DATABASE ENTRY DATE: 2019-04-01
  ref <313>: RELEVANT RESIDUES IN SEQ ID NO: (1)..(1491)

SEQ ID NO: 3427 - DNA, 1492 bp, Ensifer sp. BR816
  ref <308>: DATABASE ACCESSION NUMBER: NCBI ACCESSION: NZ_KB905370.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgcgtagcaatacgagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtccggaagaggtgagtggaattccgagtgtagaggtgaaattcgtagatattcggaggaacaccagtggcgaaggcggctcactggtccggtactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggattacagagatgttttccttcagttcggctggaccggagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgtgctaaccgcaaggaggcagctaaccacggtagggtcagcgactggggtgaagtcgtaacaaggtagccgtaggggaacctgcggctggatcacctcctttctaagg

SEQ ID NO: 3428 - DNA, 1492 bp, Ensifer sp. LC11
  ref <308>: DATABASE ACCESSION NUMBER: NCBI ACCESSION: NZ_MBSO01000007.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatacgcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacagagatgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3429 - DNA, 1492 bp, Ensifer sp. LC13; identical to SEQ ID NO: 3428
  ref <308>: DATABASE ACCESSION NUMBER: NCBI ACCESSION: NZ_MBSP01000021.1
  ref <309>: DATABASE ENTRY DATE: 2019-04-01
  ref <313>: RELEVANT RESIDUES IN SEQ ID NO: (1)..(1492)

SEQ ID NO: 3430 - DNA, 1492 bp, Ensifer sp. LC14; identical to SEQ ID NO: 3428
  ref <308>: DATABASE ACCESSION NUMBER: NCBI ACCESSION: NZ_MBSQ01000058.1
  ref <309>: DATABASE ENTRY DATE: 2019-04-01
  ref <313>: RELEVANT RESIDUES IN SEQ ID NO: (1)..(1492)

SEQ ID NO: 3431 - DNA, 1492 bp, Ensifer sp. LC163
  ref <308>: DATABASE ACCESSION NUMBER: NCBI ACCESSION: NZ_MBSS01000025.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacagagatgtaattcttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3432 - DNA, 1492 bp, Ensifer sp. LC384
  ref <308>: DATABASE ACCESSION NUMBER: NCBI ACCESSION: NZ_MBST01000058.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacagagatgtaattcttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3433 - DNA, 1492 bp, Ensifer sp. LC499; identical to SEQ ID NO: 3428
  ref <308>: DATABASE ACCESSION NUMBER: NCBI ACCESSION: NZ_MBSU01000049.1
  ref <309>: DATABASE ENTRY DATE: 2019-04-01
  ref <313>: RELEVANT RESIDUES IN SEQ ID NO: (1)..(1492)

SEQ ID NO: 3434 - DNA, 1492 bp, Ensifer sp. LC54; identical to SEQ ID NO: 3432
  ref <308>: DATABASE ACCESSION NUMBER: NCBI ACCESSION: NZ_MBSR01000094.1
  ref <309>: DATABASE ENTRY DATE: 2019-04-01
  ref <313>: RELEVANT RESIDUES IN SEQ ID NO: (1)..(1492)

SEQ ID NO: 3435 - DNA, 1491 bp, Ensifer sp. MMN 5
  ref <308>: DATABASE ACCESSION NUMBER: NCBI ACCESSION: NZ_NWVF01000055.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatctagagtccagaagaggtgagtggaattccgagtgtagaggtgaaattcgtagatattcggaggaacaccagtggcgaaggcggctcactggtctggaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggatacgagagatcgtattcttcagttcggctggatcggagacaggtgctgcatggctgtcgtcagctcgtgtcgtgagatgttgggttaagtcccgcaacgagcgcaaccctcgcccttagttgccagcattcagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 3436 - DNA, 1491 bp, Ensifer sp. NM-2
  ref <308>: DATABASE ACCESSION NUMBER: NCBI ACCESSION: NZ_PVZR01000053.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcatggaaacgtgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacagagatgtattccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaag

SEQ ID NO: 3437 - DNA, 1492 bp, Ensifer sp. Root1252
  ref <308>: DATABASE ACCESSION NUMBER: NCBI ACCESSION: NZ_LMDT01000001.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcatggaaacgtgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacagagatgtattccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3438 - DNA, 1492 bp, Ensifer sp. Root127; identical to SEQ ID NO: 3437
  ref <308>: DATABASE ACCESSION NUMBER: NCBI ACCESSION: NZ_LMDX01000001.1
  ref <309>: DATABASE ENTRY DATE: 2019-04-01
  ref <313>: RELEVANT RESIDUES IN SEQ ID NO: (1)..(1492)

SEQ ID NO: 3439 - DNA, 1492 bp, Ensifer sp. Root1298
  ref <308>: DATABASE ACCESSION NUMBER: NCBI ACCESSION: NZ_LMEN01000012.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatacgcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacggagacgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3440 - DNA, 1492 bp, Ensifer sp. Root1312; identical to SEQ ID NO: 3439
  ref <308>: DATABASE ACCESSION NUMBER: NCBI ACCESSION: NZ_LMES01000034.1
  ref <309>: DATABASE ENTRY DATE: 2019-04-01
  ref <313>: RELEVANT RESIDUES IN SEQ ID NO: (1)..(1492)

SEQ ID NO: 3441 - DNA, 1492 bp, Ensifer sp. Root142; identical to SEQ ID NO: 3437
  ref <308>: DATABASE ACCESSION NUMBER: NCBI ACCESSION: NZ_LMFK01000046.1
  ref <309>: DATABASE ENTRY DATE: 2019-04-01
  ref <313>: RELEVANT RESIDUES IN SEQ ID NO: (1)..(1492)

SEQ ID NO: 3442 - DNA, 1492 bp, Ensifer sp. Root231; identical to SEQ ID NO: 3437
  ref <308>: DATABASE ACCESSION NUMBER: NCBI ACCESSION: NZ_LMIQ01000001.1
  ref <309>: DATABASE ENTRY DATE: 2019-04-01
  ref <313>: RELEVANT RESIDUES IN SEQ ID NO: (1)..(1492)

SEQ ID NO: 3443 - DNA, 1492 bp, Ensifer sp. Root258; identical to SEQ ID NO: 3437
  ref <308>: DATABASE ACCESSION NUMBER: NCBI ACCESSION: NZ_LMIX01000001.1
  ref <309>: DATABASE ENTRY DATE: 2019-04-01
  ref <313>: RELEVANT RESIDUES IN SEQ ID NO: (1)..(1492)

SEQ ID NO: 3444 - DNA, 1492 bp, Ensifer sp. Root278
  ref <308>: DATABASE ACCESSION NUMBER: NCBI ACCESSION: NZ_LMJJ01000001.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtataagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacrgagaygttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3445 - DNA, 1492 bp, Ensifer sp. Root31; identical to SEQ ID NO: 3437
  ref <308>: DATABASE ACCESSION NUMBER: NCBI ACCESSION: NZ_LMCO01000001.1
  ref <309>: DATABASE ENTRY DATE: 2019-04-01
  ref <313>: RELEVANT RESIDUES IN SEQ ID NO: (1)..(1492)

SEQ ID NO: 3446 - DNA, 1492 bp, Ensifer sp. Root423
  ref <308>: DATABASE ACCESSION NUMBER: NCBI ACCESSION: NZ_LMEG01000034.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatacgcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggckgacatttaagtcaggggtgaaatcccggggctcaaccccggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacggagacgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3447 - DNA, 1492 bp, Ensifer sp. Root558; identical to SEQ ID NO: 3439
  ref <308>: DATABASE ACCESSION NUMBER: NCBI ACCESSION: NZ_LMGC01000033.1
  ref <309>: DATABASE ENTRY DATE: 2019-04-01
  ref <313>: RELEVANT RESIDUES IN SEQ ID NO: (1)..(1492)

SEQ ID NO: 3448 - DNA, 1492 bp, Ensifer sp. Root74; identical to SEQ ID NO: 3439
  ref <308>: DATABASE ACCESSION NUMBER: NCBI ACCESSION: NZ_LMII01000012.1
  ref <309>: DATABASE ENTRY DATE: 2019-04-01
  ref <313>: RELEVANT RESIDUES IN SEQ ID NO: (1)..(1492)

SEQ ID NO: 3449 - DNA, 1493 bp, Ensifer sp. Root954
  misc_feature (1375)..(1375): n is a, c, g, or t
  ref <308>: DATABASE ACCESSION NUMBER: NCBI ACCESSION: NZ_LMJM01000034.1
  ref <309>: DATABASE ENTRY DATE: 2019-04-01
  ref <313>: RELEVANT RESIDUES IN SEQ ID NO: (1)..(1493)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatacgcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacggagacgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctaccncgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3450 - DNA, 1491 bp, Ensifer sp. T2 8
  ref <308>: DATABASE ACCESSION NUMBER: NCBI ACCESSION: NZ_NWVT01000077.1
  ref <309>: DATABASE ENTRY DATE: 2019-04-01
  ref <313>: RELEVANT RESIDUES IN SEQ ID NO: (1)..(1491)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatctagagtccagaagaggtgagtggaattccgagtgtagaggtgaaattcgtagatattcggaggaacaccagtggcgaaggcggctcactggtctggaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggatacgagagatcgtatccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagttaaccacggtagggtcagcgactggggtgaagtcgtaacaaggtagccgtaggggaacctgcggctggatcacctcctttctaag

SEQ ID NO: 3451 - DNA, 1242 bp, Ensifer sp. USDA 6670
  ref <308>: DATABASE ACCESSION NUMBER: NCBI ACCESSION: NZ_ATWE01000067.1
  ref <309>: DATABASE ENTRY DATE: 2019-04-01
  ref <313>: RELEVANT RESIDUES IN SEQ ID NO: (1)..(1242)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtatgagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggattgttaagtgaggggtgaaatcccagggctcaaccctggaactgcctttcatactggcaatctagagtccagaagaggtgagtggaattccgagtgtagaggtgaaattcgtagatattcggaggaacaccagtggcgaaggcggctcactggtctggaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggatacgagagatcgtatccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctc

SEQ ID NO: 3452 - DNA, 1500 bp, Ensifer sp. WSM1721
  ref <308>: DATABASE ACCESSION NUMBER: NCBI ACCESSION: NZ_AZUW01000065.1
  ref <309>: DATABASE ENTRY DATE: 2019-04-01
  ref <313>: RELEVANT RESIDUES IN SEQ ID NO: (1)..(1500)
ttgaattctcaacttgagagtttgatcctggctcagaacgaacgctggcggcaggcttaacacatgcaagtcgagcgcgtagcaatacgagcggcagacgggtgagtaacgcgtgggaatctacccttttctacggaataacgcagggaaacttgtgctaataccgtatacgcccttcgggggaaagatttatcggagaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtccggaagaggtgagtggaattccgagtgtagaggtgaaattcgtagatattcggaggaacaccagtggcgaaggcggctcactggtccggaactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccggtcgcggatacgagagatcgtatccttcagttcggctggaccggagacaggtgctgcatggctgtcgtcagctcgtgtcgtgagatgttgggttaagtcccgcaacgagcgcaaccctcgcccttagttgccagcatttggttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3453 - DNA, 1492 bp, Ensifer sp. ZNC0028
  ref <308>: DATABASE ACCESSION NUMBER: NCBI ACCESSION: NZ_JTLA01000139.1
  ref <309>: DATABASE ENTRY DATE: 2019-04-01
  ref <313>: RELEVANT RESIDUES IN SEQ ID NO: (1)..(1492)
tcaacttgagagtttgatcctggctcagaacgaacgctggcggcaggcttaacacatgcaagtcgagcgccccgcaaggggagcggcagacgggtgagtaacgcgtgggaatctacccttttctacggaataacgcagggaaacttgtgctaataccgtataagcccttcgggggaaagatttatcgggaaaggatgagcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggaattactgggcgtaaagcgcacgtaggcggacatttaagtcaggggtgaaatcccggggctcaaccccggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacaggattagataccctggtagtccacgccgtaaacgatgaatgttagccgtcgggcagtttactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacatcccgatcgcggattacggagacgttttccttcagttcggctggatcggagacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagaccgcgaggtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttctacccgaaggtagtgcgctaaccgcaaggaggcagctaaccacggtagggtcagcgactggggtgaagtcgtaacaaggtagccgtaggggaacctgcggctggatcacctcctttctaagg

SEQ ID NO: 3454 - DNA, 1552 bp, Enterobacter asburiae
  ref <308>: DATABASE ACCESSION NUMBER: NCBI ACCESSION: NZ_FXLQ01000012.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3455 - DNA, 1550 bp, Enterobacter bugandensis
  ref <308>: DATABASE ACCESSION NUMBER: NCBI ACCESSION: NZ_LT992502.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataatgtcgaaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3456 - DNA, 1554 bp, Enterobacter cancerogenus
  ref <308>: DATABASE ACCESSION NUMBER: NCBI ACCESSION: NZ_FYBA01000020.1
  ref <309>: DATABASE ENTRY DATE: 2019-04-01
  ref <313>: RELEVANT RESIDUES IN SEQ ID NO: (1)..(1554)
acttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3457 - DNA, 1552 bp, Enterobacter chengduensis
  ref <308>: DATABASE ACCESSION NUMBER: NCBI ACCESSION: NZ_RWHT01000077.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggtagcacagaggagcttgctcctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggctaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3458 - DNA, 1550 bp, Enterobacter chuandaensis
  ref <308>: DATABASE ACCESSION NUMBER: NCBI ACCESSION: NZ_QZCS01000030.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3459 - DNA, 1552 bp, Enterobacter cloacae
  ref <308>: DATABASE ACCESSION NUMBER: NCBI ACCESSION: NZ_LR134164.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgacagggttaataaccctgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3460 - DNA, 1552 bp, Enterobacter cloacae complex sp.
  ref <308>: DATABASE ACCESSION NUMBER: NCBI ACCESSION: NZ_LT991957.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3461 - DNA, 1552 bp, Enterobacter cloacae complex sp. 2DZ2F16B1
  ref <308>: DATABASE ACCESSION NUMBER: NCBI ACCESSION: NZ_QFLR01000081.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3462 - DNA, 1075 bp, Enterobacter cloacae complex sp. 2DZ2F20B
  ref <308>: DATABASE ACCESSION NUMBER: NCBI ACCESSION: NZ_QFLX01000133.1
  ref <309>: DATABASE ENTRY DATE: 2019-04-01
  ref <313>: RELEVANT RESIDUES IN SEQ ID NO: (1)..(1075)
attgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3463 - DNA, 1491 bp, Enterobacter cloacae complex sp. 2DZ2F2B
  ref <308>: DATABASE ACCESSION NUMBER: NCBI ACCESSION: NZ_QFLM01000083.1
  ref <309>: DATABASE ENTRY DATE: 2019-04-01
  ref <313>: RELEVANT RESIDUES IN SEQ ID NO: (1)..(1491)
aaattgaagagtttgatcatggcgcagattgaacgctggcggcaggcctaacacatgcaagtcgaacggtaacaggaagcagcttgctgcttcgctgacgagtggcggacgggtgagtaatgtcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggtagtactttcagcggggaggaaggtgttgaggttaataacctcagcaattgacgttacacgcagaagaagcaccggctaactccttgctagcagccgctgtaatacggagggtgcaagcgttaatcggaattactgggcgtaaatcgcacgcaggcggtctgtcaagtcggatgtgaaatcccctggctcaacctgggaactgcttattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaa

SEQ ID NO: 3464 - DNA, 303 bp, Enterobacter cloacae complex sp. 3DZ3S2B
  ref <308>: DATABASE ACCESSION NUMBER: NCBI ACCESSION: NZ_QFLK01000065.1
  ref <309>: DATABASE ENTRY DATE: 2019-04-01
  ref <313>: RELEVANT RESIDUES IN SEQ ID NO: (1)..(303)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagagga

SEQ ID NO: 3465 - DNA, 1552 bp, Enterobacter cloacae complex sp. 4DZ1-17B1
  ref <308>: DATABASE ACCESSION NUMBER: NCBI ACCESSION: NZ_QFLV01000087.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3466 - DNA, 656 bp, Enterobacter cloacae complex sp. 4DZ3-17B2
  ref <308>: DATABASE ACCESSION NUMBER: NCBI ACCESSION: NZ_QFLU01000094.1
  ref <309>: DATABASE ENTRY DATE: 2019-04-01
  ref <313>: RELEVANT RESIDUES IN SEQ ID NO: (1)..(656)
tgacggaagggcaccaccaggagtggagcctgcggcttaatttgactcaacacggggaaacttaccaggtccagacatagtaaggattgacagactgagagctctttcttgattctatgggtggtggtgcatggccgttcttacttggtggagcgatttgtctggtcaattccgttaacgaacgagacctcagcctgctaaatagctatgtggaggtaaccctccacggccagcttcttagagggactatggccgcttaggccacggaagtttgaggcaataacaggtctgtgatgcccttagatgttctgggccgcacgcgcgctacactgaaggaatcagcgtgtcttccctggccgaaaggtccgggtaacccgctgaacctccttcgtgctagggattggggcttgcaattattccccatgaacgaggaattcccagtaagcgcgagtcataagctcgcgttgattacgtccctgccctttgtacacaccgcccgtcgctcctaccgattgaatggtccggtgaagtgttcggattgcggcgacgtgagcggttcgctgcccgcgacgttgtgagaagtccactgaaccttatcatttagaggaaggagaagtcgtaacaaggtttccgtaggtgaacctgcggaaggatca

SEQ ID NO: 3467 - DNA, 1552 bp, Enterobacter cloacae complex sp. 4DZ3-28B; identical to SEQ ID NO: 3465
  ref <308>: DATABASE ACCESSION NUMBER: NCBI ACCESSION: NZ_QFLT01000055.1
  ref <309>: DATABASE ENTRY DATE: 2019-04-01
  ref <313>: RELEVANT RESIDUES IN SEQ ID NO: (1)..(1552)

SEQ ID NO: 3468 - DNA, 284 bp, Enterobacter cloacae complex sp. 677-3DZ2D5B
  ref <308>: DATABASE ACCESSION NUMBER: NCBI ACCESSION: NZ_QFLS01000013.1
  ref <309>: DATABASE ENTRY DATE: 2019-04-01
  ref <313>: RELEVANT RESIDUES IN SEQ ID NO: (1)..(284)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacggtc

SEQ ID NO: 3469 - DNA, 1552 bp, Enterobacter cloacae complex sp. 742-ADZ3-9B; identical to SEQ ID NO: 3465
  ref <308>: DATABASE ACCESSION NUMBER: NCBI ACCESSION: NZ_QFLW01000062.1
  ref <309>: DATABASE ENTRY DATE: 2019-04-01
  ref <313>: RELEVANT RESIDUES IN SEQ ID NO: (1)..(1552)

SEQ ID NO: 3470 - DNA, 1552 bp, Enterobacter cloacae complex sp. 743-2DZ2F-22B; identical to SEQ ID NO: 3465
  ref <308>: DATABASE ACCESSION NUMBER: NCBI ACCESSION: NZ_QFLN01000051.1
  ref <309>: DATABASE ENTRY DATE: 2019-04-01
  ref <313>: RELEVANT RESIDUES IN SEQ ID NO: (1)..(1552)

SEQ ID NO: 3471 - DNA, 1552 bp, Enterobacter cloacae complex sp. CH23B; identical to SEQ ID NO: 3461
  ref <308>: DATABASE ACCESSION NUMBER: NCBI ACCESSION: NZ_QFLQ01000138.1
  ref <309>: DATABASE ENTRY DATE: 2019-04-01
  ref <313>: RELEVANT RESIDUES IN SEQ ID NO: (1)..(1552)

SEQ ID NO: 3472 - DNA, 1550 bp, Enterobacter cloacae complex sp. ECNIH10
  ref <308>: DATABASE ACCESSION NUMBER: NCBI ACCESSION: NZ_PQLB01000037.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3473 - DNA, 1552 bp, Enterobacter cloacae complex sp. ECNIH11
  ref <308>: DATABASE ACCESSION NUMBER: NCBI ACCESSION: NZ_PQKX01000053.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3474 - DNA, 1552 bp, Enterobacter cloacae complex sp. ECNIH12
  ref <308>: DATABASE ACCESSION NUMBER: NCBI ACCESSION: NZ_PQKV01000104.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgacagggttaataaccctgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3475 - DNA, 1552 bp, Enterobacter cloacae complex sp. ECNIH13
  ref <308>: DATABASE ACCESSION NUMBER: NCBI ACCESSION: NZ_PQKU01000045.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3476 - DNA, 1552 bp, Enterobacter cloacae complex sp. ECNIH14
  ref <308>: DATABASE ACCESSION NUMBER: NCBI ACCESSION: NZ_PQKZ01000083.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgttgaggttaataacctcagcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3477 - DNA, 1552 bp, Enterobacter cloacae complex sp. ECNIH15; identical to SEQ ID NO: 3475
  ref <308>: DATABASE ACCESSION NUMBER: NCBI ACCESSION: NZ_PQLA01000044.1
  ref <309>: DATABASE ENTRY DATE: 2019-04-01
  ref <313>: RELEVANT RESIDUES IN SEQ ID NO: (1)..(1552)

SEQ ID NO: 3478 - DNA, 1552 bp, Enterobacter cloacae complex sp. ECNIH16
  ref <308>: DATABASE ACCESSION NUMBER: NCBI ACCESSION: NZ_PQKW01000056.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggctaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3479 - DNA, 1552 bp, Enterobacter cloacae complex sp. ECNIH17; identical to SEQ ID NO: 3474
  ref <308>: DATABASE ACCESSION NUMBER: NCBI ACCESSION: NZ_PQLD01000063.1
  ref <309>: DATABASE ENTRY DATE: 2019-04-01
  ref <313>: RELEVANT RESIDUES IN SEQ ID NO: (1)..(1552)

SEQ ID NO: 3480 - DNA, 1554 bp, Enterobacter cloacae complex sp. ECNIH6
  ref <308>: DATABASE ACCESSION NUMBER: NCBI ACCESSION: NZ_NAVE01000035.1
  ref <309>: DATABASE ENTRY DATE: 2019-04-01
  ref <313>: RELEVANT RESIDUES IN SEQ ID NO: (1)..(1554)
acttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3481 - DNA, 1556 bp, Enterobacter cloacae complex sp. ECNIH7
  ref <308>: DATABASE ACCESSION NUMBER: NCBI ACCESSION: NZ_CP017990.1
  ref <309>: DATABASE ENTRY DATE: 2019-04-01
  ref <313>: RELEVANT RESIDUES IN SEQ ID NO: (1)..(1556)
acttaaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggctaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3482 - DNA, 1369 bp, Enterobacter cloacae complex sp. ECNIH8
  ref <308>: DATABASE ACCESSION NUMBER: NCBI ACCESSION: NZ_PQKY01000053.1
  ref <309>: DATABASE ENTRY DATE: 2019-04-01
  ref <313>: RELEVANT RESIDUES IN SEQ ID NO: (1)..(1369)
gtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3483 - DNA, 1550 bp, Enterobacter cloacae complex sp. ECNIH9
  ref <308>: DATABASE ACCESSION NUMBER: NCBI ACCESSION: NZ_PQLC01000036.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3484 - DNA, 1550 bp, Enterobacter cloacae complex sp. FDA-CDC-AR 0132
  ref <308>: DATABASE ACCESSION NUMBER: NCBI ACCESSION: NZ_CP027618.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3485 - DNA, 1550 bp, Enterobacter cloacae complex sp. FDA-CDC-AR 0164
  ref <308>: DATABASE ACCESSION NUMBER: NCBI ACCESSION: NZ_CP028950.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3486 - DNA, 1537 bp, Enterobacter cloacae complex sp. GF14B
  ref <308>: DATABASE ACCESSION NUMBER: NCBI ACCESSION: NZ_QFRV01000144.1
  ref <309>: DATABASE ENTRY DATE: 2019-04-01
  ref <313>: RELEVANT RESIDUES IN SEQ ID NO: (1)..(1537)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacct

SEQ ID NO: 3487 - DNA, 1552 bp, Enterobacter cloacae complex sp. TREC1
  ref <308>: DATABASE ACCESSION NUMBER: NCBI ACCESSION: NZ_PJZE01000027.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3488 - DNA, 1550 bp, Enterobacter genomosp. O
  ref <308>: DATABASE ACCESSION NUMBER: NCBI ACCESSION: NZ_LVUF01000009.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtaacacagggagcttgctcctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3489 - DNA, 1552 bp, Enterobacter genomosp. S
  ref <308>: DATABASE ACCESSION NUMBER: NCBI ACCESSION: NZ_LVVA01000014.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3490 - DNA, 1552 bp, Enterobacter hormaechei
  ref <308>: DATABASE ACCESSION NUMBER: NCBI ACCESSION: NZ_LT991954.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3491 - DNA, 1550 bp, Enterobacter huaxiensis
  ref <308>: DATABASE ACCESSION NUMBER: NCBI ACCESSION: NZ_RWHU01000019.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagggagcttgctcctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3492 - DNA, 1002 bp, Enterobacter kobei
  ref <308>: DATABASE ACCESSION NUMBER: NCBI ACCESSION: NZ_FYBC01000017.1
  ref <309>: DATABASE ENTRY DATE: 2019-04-01
  ref <313>: RELEVANT RESIDUES IN SEQ ID NO: (1)..(1002)
acttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatcca

SEQ ID NO: 3493 - DNA, 1554 bp, Enterobacter ludwigii
  ref <308>: DATABASE ACCESSION NUMBER: NCBI ACCESSION: NZ_FYBD01000020.1
  ref <309>: DATABASE ENTRY DATE: 2019-04-01
  ref <313>: RELEVANT RESIDUES IN SEQ ID NO: (1)..(1554)
acttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3494 - DNA, 1460 bp, Enterobacter ludwigii
gggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3495 - DNA, 1460 bp, Enterobacter ludwigii; identical to SEQ ID NO: 3494

SEQ ID NO: 3496 - DNA, 1460 bp, Enterobacter ludwigii; identical to SEQ ID NO: 3494

SEQ ID NO: 3497 - DNA, 1525 bp, Enterobacter mori
  ref <308>: DATABASE ACCESSION NUMBER: NCBI ACCESSION: NZ_RXPP01000080.1
  ref <309>: DATABASE ENTRY DATE: 2019-04-01
  ref <313>: RELEVANT RESIDUES IN SEQ ID NO: (1)..(1525)
aaattgaagagtttgatcatggctcagattgaacgctggcggcaggcctaacacatgcaagtcgagcggtaacacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggt

SEQ ID NO: 3498 - DNA, 1552 bp, Enterobacter roggenkampii
  ref <308>: DATABASE ACCESSION NUMBER: NCBI ACCESSION: NZ_CP032916.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3499 - DNA, 1550 bp, Enterobacter sichuanensis
  ref <308>: DATABASE ACCESSION NUMBER: NCBI ACCESSION: NZ_POVL01000141.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3500 - DNA, 1552 bp, Enterobacter soli
  ref <308>: DATABASE ACCESSION NUMBER: NCBI ACCESSION: NZ_FYBB01000009.1
  ref <309>: DATABASE ENTRY DATE: 2019-04-01
  ref <313>: RELEVANT RESIDUES IN SEQ ID NO: (1)..(1552)
ttaaattgaagagtttgatcatggctcagattgaacgctggcggcaggcctaacacatgcaagtcgagcggtaacacagggagcttgctcctgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3501 - DNA, 1284 bp, Enterobacter sp. 10-1
  ref <308>: DATABASE ACCESSION NUMBER: NCBI ACCESSION: NZ_NISF01000022.1
  ref <309>: DATABASE ENTRY DATE: 2019-04-01
  ref <313>: RELEVANT RESIDUES IN SEQ ID NO: (1)..(1284)
ggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgataaggttaataaccttgtcgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3502 - DNA, 1552 bp, Enterobacter sp. 301B; identical to SEQ ID NO: 3474
  ref <308>: DATABASE ACCESSION NUMBER: NCBI ACCESSION: NZ_PQTC01000063.1
  ref <309>: DATABASE ENTRY DATE: 2019-04-01
  ref <313>: RELEVANT RESIDUES IN SEQ ID NO: (1)..(1552)

SEQ ID NO: 3503 - DNA, 1550 bp, Enterobacter sp. 50588862
  ref <308>: DATABASE ACCESSION NUMBER: NCBI ACCESSION: NZ_LNHM01000027.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3504 - DNA, 1006 bp, Enterobacter sp. 50793107
  ref <308>: DATABASE ACCESSION NUMBER: NCBI ACCESSION: NZ_LNII01000045.1
  ref <309>: DATABASE ENTRY DATE: 2019-04-01
  ref <313>: RELEVANT RESIDUES IN SEQ ID NO: (1)..(1006)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactt

SEQ ID NO: 3505 - DNA, 815 bp, Enterobacter sp. 50858885
  ref <308>: DATABASE ACCESSION NUMBER: NCBI ACCESSION: NZ_LNIO01000069.1
  ref <309>: DATABASE ENTRY DATE: 2019-04-01
  ref <313>: RELEVANT RESIDUES IN SEQ ID NO: (1)..(815)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaa

SEQ ID NO: 3506 - DNA, 1550 bp, Enterobacter sp. 9-2
  ref <308>: DATABASE ACCESSION NUMBER: NCBI ACCESSION: NZ_QQXP01000031.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3507 - DNA, 1550 bp, Enterobacter sp. AM17-18; identical to SEQ ID NO: 3472
  ref <308>: DATABASE ACCESSION NUMBER: NCBI ACCESSION: NZ_QTLJ01000004.1
  ref <309>: DATABASE ENTRY DATE: 2019-04-01
  ref <313>: RELEVANT RESIDUES IN SEQ ID NO: (1)..(1550)

SEQ ID NO: 3508 - DNA, 1449 bp, Enterobacter sp. Ag1
  ref <308>: DATABASE ACCESSION NUMBER: NCBI ACCESSION: NZ_AKXM01000010.1
  ref <309>: DATABASE ENTRY DATE: 2019-04-01
  ref <313>: RELEVANT RESIDUES IN SEQ ID NO: (1)..(1449)
ttaaattgaagagtttgatcatggctcagattgaacgctggcggcaggcctaacacatgcaagtcgagcggtagcacagggagcttgctcctgggtgacgagcggcggacgggtgagtaatgtctggggatctgcctgatggagggggataactactggaaacggtagctaataccgcataacgtcgcaagaccaaagagggggaccttcgggcctcttgccatcagatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattaaggttaataaccttggtgattgacgttactcgcagaagaagcaccggctaactccgtgccagcagccgcggtaatacggagggtgcaagcgttaatcggaattactgggcgtaaagcgcacgcaggcggtttgttaagtcggatgtgaaatccccgggctcaacctgggaactgcattcgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaacc

SEQ ID NO: 3509 - DNA, 1552 bp, Enterobacter sp. B509
  ref <308>: DATABASE ACCESSION NUMBER: NCBI ACCESSION: NZ_BADM01000064.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3510 - DNA, 1552 bp, Enterobacter sp. BIDMC 28
  ref <308>: DATABASE ACCESSION NUMBER: NCBI ACCESSION: NZ_KI973172.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3511 - DNA, 1550 bp, Enterobacter sp. BIGb0359
  ref <308>: DATABASE ACCESSION NUMBER: NCBI ACCESSION: NZ_RKHS01000016.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcattaaggttaataaccttagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaa

SEQ ID NO: 3512 - DNA, 1550 bp, Enterobacter sp. BIGb0383; identical to SEQ ID NO: 3511
  ref <308>: DATABASE ACCESSION NUMBER: NCBI ACCESSION: NZ_RJKQ01000014.1
  ref <309>: DATABASE ENTRY DATE: 2019-04-01
  ref <313>: RELEVANT RESIDUES IN SEQ ID NO: (1)..(1550)

SEQ ID NO: 3513 - DNA, 532 bp, Enterobacter sp. CGMCC 5087
  ref <308>: DATABASE ACCESSION NUMBER: NCBI ACCESSION: NZ_QFXN01000369.1
  ref <309>: DATABASE ENTRY DATE: 2019-04-01
  ref <313>: RELEVANT RESIDUES IN SEQ ID NO: (1)..(532)
ttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3514 - DNA, 1552 bp, Enterobacter sp. CRENT-193; identical to SEQ ID NO: 3460
  ref <308>: DATABASE ACCESSION NUMBER: NCBI ACCESSION: NZ_CP024812.1
  ref <309>: DATABASE ENTRY DATE: 2019-04-01
  ref <313>: RELEVANT RESIDUES IN SEQ ID NO: (1)..(1552)

SEQ ID NO: 3515 - DNA, 1552 bp, Enterobacter sp. Crenshaw
  ref <308>: DATABASE ACCESSION NUMBER: NCBI ACCESSION: NZ_CP020817.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataatgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3516 - DNA, 1552 bp, Enterobacter sp. DKU NT 01; identical to SEQ ID NO: 3475
  ref <308>: DATABASE ACCESSION NUMBER: NCBI ACCESSION: NZ_CP021137.1
  ref <309>: DATABASE ENTRY DATE: 2019-04-01
  ref <313>: RELEVANT RESIDUES IN SEQ ID NO: (1)..(1552)

SEQ ID NO: 3517 - DNA, 1554 bp, Enterobacter sp. EC-NT1
  ref <308>: DATABASE ACCESSION NUMBER: NCBI ACCESSION: NZ_QBFJ01000061.1
  ref <309>: DATABASE ENTRY DATE: 2019-04-01
  ref <313>: RELEVANT RESIDUES IN SEQ ID NO: (1)..(1554)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttactcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaaccttgtagagatacgagggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagc

SEQ ID NO: 3518 - DNA, 1076 bp, Enterobacter sp. FS01
  ref <308>: DATABASE ACCESSION NUMBER: NCBI ACCESSION: NZ_PVZP01000029.1
  ref <309>: DATABASE ENTRY DATE: 2019-04-01
  ref <313>: RELEVANT RESIDUES IN SEQ ID NO: (1)..(1076)
gattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3519 - DNA, 1075 bp, Enterobacter sp. GER MD16 1505 Eko 090
  ref <308>: DATABASE ACCESSION NUMBER: NCBI ACCESSION: NZ_PUQF01000066.1
  ref <309>: DATABASE ENTRY DATE: 2019-04-01
  ref <313>: RELEVANT RESIDUES IN SEQ ID NO: (1)..(1075)
attgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3520 - DNA, 1454 bp, Enterobacter sp. HN503E2II
  ref <308>: DATABASE ACCESSION NUMBER: NCBI ACCESSION: NZ_PCFB01000109.1
  ref <309>: DATABASE ENTRY DATE: 2019-04-01
  ref <313>: RELEVANT RESIDUES IN SEQ ID NO: (1)..(1454)
cgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggactggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3521 - DNA, 1135 bp, Enterobacter sp. HPCN14
  ref <308>: DATABASE ACCESSION NUMBER: NCBI ACCESSION: NZ_QGNL01000017.1
  ref <309>: DATABASE ENTRY DATE: 2019-04-01
  ref <313>: RELEVANT RESIDUES IN SEQ ID NO: (1)..(1135)
aaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggt

SEQ ID NO: 3522 - DNA, 1550 bp, Enterobacter sp. K66-74
  ref <308>: DATABASE ACCESSION NUMBER: NCBI ACCESSION: NZ_LNHC01000085.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3523 - DNA, 1552 bp, Enterobacter sp. KINAN-G
  ref <308>: DATABASE ACCESSION NUMBER: NCBI ACCESSION: NZ_BBKD01000336.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgttgaggttaataacctcagcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3524 - DNA, 1552 bp, Enterobacter sp. MR1
  ref <308>: DATABASE ACCESSION NUMBER: NCBI ACCESSION: NZ_ARPV01000631.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgctgaggctaataacctcagcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3525 - DNA, 1552 bp, Enterobacter sp. N18-03635
  ref <308>: DATABASE ACCESSION NUMBER: NCBI ACCESSION: NZ_CP034769.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3526 - DNA, 333 bp, Enterobacter sp. NFIX04
  ref <308>: DATABASE ACCESSION NUMBER: NCBI ACCESSION: NZ_FONC01000019.1
  ref <309>: DATABASE ENTRY DATE: 2019-04-01
  ref <313>: RELEVANT RESIDUES IN SEQ ID NO: (1)..(333)
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggcggggtaatggcccacctaggcgacgatccctagctggtctgagaggatgaccagccacactggaactgagacacggt

SEQ ID NO: 3527 - DNA, 200 bp, Enterobacter sp. NFIX06
  ref <308>: DATABASE ACCESSION NUMBER: NCBI ACCESSION: NZ_FPAV01000010.1
  ref <309>: DATABASE ENTRY DATE: 2019-04-01
  ref <313>: RELEVANT RESIDUES IN SEQ ID NO: (1)..(200)
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagag

SEQ ID NO: 3528 - DNA, 242 bp, Enterobacter sp. NFIX08
  ref <308>: DATABASE ACCESSION NUMBER: NCBI ACCESSION: NZ_FOYJ01000005.1
  ref <309>: DATABASE ENTRY DATE: 2019-04-01
  ref <313>: RELEVANT RESIDUES IN SEQ ID NO: (1)..(242)
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatggg

SEQ ID NO: 3529 - DNA, 265 bp, Enterobacter sp. NFIX09
  ref <308>: DATABASE ACCESSION NUMBER: NCBI ACCESSION: NZ_FOHP01000004.1
  ref <309>: DATABASE ENTRY DATE: 2019-04-01
  ref <313>: RELEVANT RESIDUES IN SEQ ID NO: (1)..(265)
ttaaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggcggggtaatg

SEQ ID NO: 3530 - DNA, 1438 bp, Enterobacter sp. OLF
  ref <308>: DATABASE ACCESSION NUMBER: NCBI ACCESSION: NZ_LJAN01000069.1
  ref <309>: DATABASE ENTRY DATE: 2019-04-01
  ref <313>: RELEVANT RESIDUES IN SEQ ID NO: (1)..(1438)
gagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3531 - DNA, 1454 bp, Enterobacter sp. PN108E5IIB
  ref <308>: DATABASE ACCESSION NUMBER: NCBI ACCESSION: NZ_PCFC01000026.1
  ref <309>: DATABASE ENTRY DATE: 2019-04-01
  ref <313>: RELEVANT RESIDUES IN SEQ ID NO: (1)..(1454)
cgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3532 - DNA, 1553 bp, Enterobacter sp. R1 2018
  ref <308>: DATABASE ACCESSION NUMBER: NCBI ACCESSION: NZ_RCAA01000003.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgaacggtagcgggaagaagcttgcttctttgccgacgagtggcggacgggtgagtaatgtctgggaaactgcctgatggcgggggataactactggaaacggtagctaataccgcataacgtcgcaagaccaaagagggggaccttcgggcctcttgccatcagatgtgcccagatgggattagcttgtaggttgggttaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcggtaaggttaataaccttgccgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaaggaattgacgggggcccgcacaagcggtggagcatgtggtttaattcgatgcaacgcgaagaaccttacctactcttgacatccagagaacttgccagagatggcttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttaccttaaaga

SEQ ID NO: 3533 - DNA, 1550 bp, Enterobacter sp. R4-368
  ref <308>: DATABASE ACCESSION NUMBER: NCBI ACCESSION: NC_021500.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaggttaataaccttgctcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagagggaggtagaattccaggtgtagcggtgaaatgcgtagagatctggaggaataccggtggcgaaggcggcctcctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3534 - DNA, 1361 bp, Enterobacter sp. RC4
  ref <308>: DATABASE ACCESSION NUMBER: NCBI ACCESSION: NZ_PTLU01000004.1
  ref <309>: DATABASE ENTRY DATE: 2019-04-01
  ref <313>: RELEVANT RESIDUES IN SEQ ID NO: (1)..(1361)
aacggggagcaggtcagctgcttcgctgacgagtggcggacgggtgagtaatgtctgggaaactgcctgatggagggggataactactggaaacggtagctaataccgcataacgtcacaagaccaaagagggggaccttcgggcctcttgccatcggatgtgcccaaatgggattagctagtaggtggggtaacggctcacctaggcgacgatccctagctggtctgagaggatgaccagccacactggaactgagacacggtccagactcctacgggaggcggcagtggggaatattgcacaatgggcgcaagcctgatgcacccatgccgcgtgtatgaacaaggccttcgggttgtaaagtactttcagcggggaggaaggcgataaggttaataaccttgtcgattgacgttacccgcagaacaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagatttccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcccaagcggtggagcatgtggtttaattggatgcaacgcgaagaaccttacctactcttgacatccagagaacttaccagagatggtttggtgccttcgggaactttgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaa

SEQ ID NO: 3535 - DNA, 1504 bp, Enterobacter sp. RIT 418
  ref <308>: DATABASE ACCESSION NUMBER: NCBI ACCESSION: NZ_QBJD02000037.1
  ref <309>: DATABASE ENTRY DATE: 2019-04-01
  ref <313>: RELEVANT RESIDUES IN SEQ ID NO: (1)..(1504)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgtgcccttgaggcgtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtggatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggt

SEQ ID NO: 3536 - DNA, 1552 bp, Enterobacter sp. ST121 950178628; identical to SEQ ID NO: 3465
  ref <308>: DATABASE ACCESSION NUMBER: NCBI ACCESSION: NZ_LJDO02000110.1
  ref <309>: DATABASE ENTRY DATE: 2019-04-01
  ref <313>: RELEVANT RESIDUES IN SEQ ID NO: (1)..(1552)

SEQ ID NO: 3537 - DNA, 1556 bp, Enterobacter sp. TUM13743
  ref <308>: DATABASE ACCESSION NUMBER: NCBI ACCESSION: NZ_BDSF01000062.1
  ref <309>: DATABASE ENTRY DATE: 2019-04-01
  ref <313>: RELEVANT RESIDUES IN SEQ ID NO: (1)..(1556)
acttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgacagggttaataaccctgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3538 - DNA, 1550 bp, Enterobacter sp. WCHEn045836
  ref <308>: DATABASE ACCESSION NUMBER: NCBI ACCESSION: NZ_RXPT01000041.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccacagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3539 - DNA, 1550 bp, Enterobacter sp. WCHEn090032
  ref <308>: DATABASE ACCESSION NUMBER: NCBI ACCESSION: NZ_RXRN01000060.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3540 - DNA, 1552 bp, Enterobacter sp. WCHEn090040
  ref <308>: DATABASE ACCESSION NUMBER: NCBI ACCESSION: NZ_RXSJ01000023.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcatcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3541 - DNA, 1460 bp, Enterobacter sp. WP 7 1
  ref <308>: DATABASE ACCESSION NUMBER: NCBI ACCESSION: NZ_REFK01000012.1
  ref <309>: DATABASE ENTRY DATE: 2019-04-01
  ref <313>: RELEVANT RESIDUES IN SEQ ID NO: (1)..(1460)
gggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3542 - DNA, 1460 bp, Enterobacter sp. WP 7 2; identical to SEQ ID NO: 3541
  ref <308>: DATABASE ACCESSION NUMBER: NCBI ACCESSION: NZ_REFN01000003.1
  ref <309>: DATABASE ENTRY DATE: 2019-04-01
  ref <313>: RELEVANT RESIDUES IN SEQ ID NO: (1)..(1460)

SEQ ID NO: 3543 - DNA, 1037 bp, Enterobacter tabaci
  ref <308>: DATABASE ACCESSION NUMBER: NCBI ACCESSION: NZ_QZDQ01000024.1
  ref <309>: DATABASE ENTRY DATE: 2019-04-01
  ref <313>: RELEVANT RESIDUES IN SEQ ID NO: (1)..(1037)
cgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggt

SEQ ID NO: 3544 - DNA, 1552 bp, Enterobacteriaceae bacterium CCUG 66741
  ref <308>: DATABASE ACCESSION NUMBER: NCBI ACCESSION: NZ_LYLP01000104.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgagcggtaacacaggagagcttgctctctgggtgacgagcggcggacgggtgagtaatgtctgggaaactgcccgatggagggggataactactggaaacggtagctaataccgcataacgtcttcggaccaaagagggggaccttcgggcctcttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttgtggttaataaccgcaacgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3545 - DNA, 1552 bp, Enterobacteriaceae bacterium ENNIH1
  ref <308>: DATABASE ACCESSION NUMBER: NCBI ACCESSION: NZ_CP026193.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtaacaggaagcagcttgctgctttgctgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctagtaggtggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcagtacggttaataaccgtgctgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3546 - DNA, 1552 bp, Enterobacteriaceae bacterium Larv1 ips
  ref <308>: DATABASE ACCESSION NUMBER: NCBI ACCESSION: NZ_MEHU01000001.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaagggttcagtgttaatagcactgaacattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaattcgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcatatacaaagagaagcgaactcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 3547 - DNA, 1550 bp, Enterobacteriaceae bacterium S05
  ref <308>: DATABASE ACCESSION NUMBER: NCBI ACCESSION: NZ_CP024784.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctggtcttgacatccacagaacttagcagagatgctttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3548 - DNA, 1550 bp, Enterobacteriaceae bacterium w17
  ref <308>: DATABASE ACCESSION NUMBER: NCBI ACCESSION: NZ_CP031101.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccacagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgccagagatggcttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3549 - DNA, 1550 bp, Enterobacteriaceae bacterium w6
  ref <308>: DATABASE ACCESSION NUMBER: NCBI ACCESSION: NZ_CP031104.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttgccagagatggcttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 3550 - DNA, 1567 bp, Enterococcus aquimarinus
  ref <308>: DATABASE ACCESSION NUMBER: NCBI ACCESSION: NZ_JXKD01000005.1
  ref <309>: DATABASE ENTRY DATE: 2019-04-01
  ref <313>: RELEVANT RESIDUES IN SEQ ID NO: (1)..(1567)
ttttaatgagagtttgatcctggctcaggacgaacgctggcggcgtgcctaatacatgcaagtcgaacgcttctttttcatcgaacttcggttcatcggaaaagaagagtggcgaacgggtgagtaacacgtgggtaacctacccatcagcgggggataacacttggaaacaggtgctaataccgcataatctttttctccgcctggagagaaagtgaaaggcgcttttgcgtcactgatggatggacccgcgctgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaataaggatgagagtaaaaagttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgagaaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaggtacaacgagtcgccaagccgcgaggctgagctaatctcttaaaacctctctcagttcggattgtaggctgcaactcgcctacatgaagccggaatcgctagtaatcgcggatcagcatgccgcggtgaatacgttcccgggccttgtacacaccgcccgtcacaccacgaaagtttgtaacacccgaagtcgatgaggtaacctttttggagccagtcgcctaaggtgggatagatgattggggtgaagtcgtaacaaggtagccgtatcggaaggtgcggctggatcacctcctttctaaggaa

SEQ ID NO: 3551 - DNA, 1566 bp, Enterococcus asini
  ref <308>: DATABASE ACCESSION NUMBER: NCBI ACCESSION: NZ_QRZW01000022.1
  ref <309>: DATABASE ENTRY DATE: 2019-04-01
  ref <313>: RELEVANT RESIDUES IN SEQ ID NO: (1)..(1566)
ttttatgagagtttgatcctggctcaggacgaacgctggcggcgtgcctaatacatgcaagtcgaacgcttttgttttcaccggagcttgctccaccgaaaacaaaagagtggcggacgggtgagtaacacgtgggtaacctgcctcaagcgggggataacacttggaaacaggtgctaataccgcataataatcagaatcgcatgattttgatttgaaaggcgcttttgcgtcacttgaggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagggtgagagtagaatgttcaccccttgacggtatctaaccagaaagccacggctaactacgtgccagcagccgcggtaatacgtaggtggcaagcgttgtccggatttattgggcgtaaagcgagcgcaggcggtctcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3552 - DNA, 1567 bp, Enterococcus avium
  ref <308>: DATABASE ACCESSION NUMBER: NCBI ACCESSION: NZ_UGIH01000004.1
  ref <309>: DATABASE ENTRY DATE: 2019-04-01
  ref <313>: RELEVANT RESIDUES IN SEQ ID NO: (1)..(1567)
ttttatgagagtttgatcctggctcaggacgaacgctggcggcgtgcctaatacatgcaagtcgaacgctttttctttcaccggagcttgctccaccgaaagaaaaggagtggcgaacgggtgagtaacacgtgggtaacctgcccatcagaaggggataacacttggaaacaggtgctaataccgtataacaatcgaaaccgcatggtttcggtttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgcaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3553 - DNA, 532 bp, Enterococcus caccae
  ref <308>: DATABASE ACCESSION NUMBER: NCBI ACCESSION: NZ_JXKJ01000053.1
  ref <309>: DATABASE ENTRY DATE: 2019-04-01
  ref <313>: RELEVANT RESIDUES IN SEQ ID NO: (1)..(532)
ccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgacca

SEQ ID NO: 3554 - DNA, 1466 bp, Enterococcus canintestini
  ref <308>: DATABASE ACCESSION NUMBER: NCBI ACCESSION: NZ_LHUG01000016.1
  ref <309>: DATABASE ENTRY DATE: 2019-04-01
  ref <313>: RELEVANT RESIDUES IN SEQ ID NO: (1)..(1466)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgccctcaagcgggggataacacttggaaacaggtgctaataccgcataacaatagtaaacacatgtttattatttgaaaggcgcttttgcgtcacttgaggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaac

SEQ ID NO: 3555 - DNA, 1570 bp, Enterococcus canis
  ref <308>: DATABASE ACCESSION NUMBER: NCBI ACCESSION: NZ_JXKH01000028.1
  ref <309>: DATABASE ENTRY DATE: 2019-04-01
  ref <313>: RELEVANT RESIDUES IN SEQ ID NO: (1)..(1570)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgacaccgcatggtgttgatttgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagagtgagagtaactgttcactccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttatggagccagccgcctaaggtgggatagatgattggggtgaagtcgtaacaaggtagccgtatcggaaggtgcggctggatcacctcctttctaaggaa

SEQ ID NO: 3556 - DNA, 1565 bp, Enterococcus casseliflavus
  ref <308>: DATABASE ACCESSION NUMBER: NCBI ACCESSION: NZ_UGIQ01000001.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3557 - DNA, 1567 bp, Enterococcus cecorum
  ref <308>: DATABASE ACCESSION NUMBER: NCBI ACCESSION: NZ_LS483306.1
  ref <309>: DATABASE ENTRY DATE: 2019-04-01
  ref <313>: RELEVANT RESIDUES IN SEQ ID NO: (1)..(1567)
ttttatgagagtttgatcctggctcaggacgaacgctggcggcgtgcctaatacatgcaagtcgaacgcattttctatcaccgtagcttgctacaccggaagaaaatgagtggcgaacgggtgagtaacacgtgggtaacctgcccatcagcgggggataacacttggaaacaggtgctaataccgcataattccatctaccgcatggtagatggatgaaaggcacttttgcgtcactgatggatggacccgcggtgcattagctagttggtggggtaacggcctaccaaggctgcgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaaactctgttgttagagaagaacaaggatgagagtggaaagttcatcccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagcccccggcttaaccggggagggtcattggaaactgggagacttgagtgcagaagaggaaagcggaattccatgtgtagcggtgaaatgcgtagatatatggaggaacaccagtggcgaaggcggctttctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccatcctagagataggattttcccttcggggacaaagtgacaggtggtgcatggttgtcgtcagctcgtgtcgtgagatgttgggttaagtcccgcaacgagcgcaacccttattgttagttaccatcattcagttgggcactctagcgagactgccgcagacaatgcggaggaaggtggggatgacgtcaaatcatcatgccccttatgacctgggctacacacgtgctacaatggagagtacaacgagtcgcaaagccgcgaggctaagccaatctcttaaagctcttctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccaaagccggtgcggtaaccgtaaggagccagccgtctaaggtgggatagatgattggggtgaagtcgtaacaaggtagccgtatcggaaggtgcggctggatcacctcctttctaaggaa

SEQ ID NO: 3558 - DNA, 1567 bp, Enterococcus columbae
  ref <308>: DATABASE ACCESSION NUMBER: NCBI ACCESSION: NZ_JXKI01000057.1
  ref <309>: DATABASE ENTRY DATE: 2019-04-01
  ref <313>: RELEVANT RESIDUES IN SEQ ID NO: (1)..(1567)
ttttatgagagtttgatcctggctcaggacgaacgctggcggcgtgcctaatacatgcaagtcgaacgcactttctttcaccgtagcttgctacaccgaaagaaagtgagtggcgaacgggtgagtaacacgtgggtaacctgcccatcagcgggggataacacttggaaacaggtgctaataccgcataatattacttttcgcatgagaagtaattgaaaggcgcaactgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgcaagtctgaccgagcaacgccgcgtgagtgaagaaggttttcggatcgtaaaactctgttgttagagaagaacagggatgagagtggaaagttcatcctatgacggtatctaaccagaaagccacggctaactacgtgccagcagccgcggtaatacgtaggtggcaagcgttgtccggatttattgggcgtaaagcgagcgcaggcggtcttttaagtctgatgtgaaagcccacggcttaaccgtggagggtcattggaaactgggagacttgagtgcagaagaggaaagcggaattccatgtgtagcggtgaaatgcgtagatatatggaggaacaccagtggcgaaggcggctttctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccatcctagagataggactttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccgcagacaatgcggaggaaggtggggatgacgtcaaatcatcatgccccttatgacctgggctacacacgtgctacaatggagagtacaacgagttgcgaagtcgtgaggctaagctaatctcttaaagctcttctcagttcggattgtaggctgcaactcgcctacatgaagccggaatcgctagtaatcgcggatcagcacgccgcggtgaatacgttcccgggtcttgtacacaccgcccgtcacaccacgagagtttgtaacacccgaagccggtggggtaaccgcaaggagccagccgtctaaggtgggatagatgattggggtgaagtcgtaacaaggtagccgtatcggaaggtgcggctggatcacctcctttctaaggaa

SEQ ID NO: 3559 - DNA, 510 bp, Enterococcus devriesei
  ref <308>: DATABASE ACCESSION NUMBER: NCBI ACCESSION: NZ_JXKM01000044.1
  ref <309>: DATABASE ENTRY DATE: 2019-04-01
  ref <313>: RELEVANT RESIDUES IN SEQ ID NO: (1)..(510)
agtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3560 - DNA, 1470 bp, Enterococcus dispar
  ref <308>: DATABASE ACCESSION NUMBER: NCBI ACCESSION: NZ_JXKN01000046.1
  ref <309>: DATABASE ENTRY DATE: 2019-04-01
  ref <313>: RELEVANT RESIDUES IN SEQ ID NO: (1)..(1470)
ttttatgagagtttgatcctggctcaggacgaacgctggcggcgtgcctaatacatgcaagtcgaacgcttctttttccaccggagcttgctccaccggaaaaagaagagtggcgaacgggtgagtaacacgtgggtaacctaccctcaagcgggggataacatttggaaacaggtgctaataccgcataatattaatgaactcatgtttattaattgaaaggcgcttttgcgtcacttgaggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 3561 - DNA, 1567 bp, Enterococcus durans
  ref <308>: DATABASE ACCESSION NUMBER: NCBI ACCESSION: NZ_UGIF01000002.1
  ref <309>: DATABASE ENTRY DATE: 2019-04-01
  ref <313>: RELEVANT RESIDUES IN SEQ ID NO: (1)..(1567)
tatgagagtttgatcctggctcaggacgaacgctggcggcgtgcctaatacatgcaagtcgtacgcttctttttttccaccggagcttgctccaccggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3562 - DNA, 1566 bp, Enterococcus faecalis
  ref <308>: DATABASE ACCESSION NUMBER: NCBI ACCESSION: NZ_LR134312.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttctttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3563 - DNA, 1568 bp, Enterococcus faecium
  ref <308>: DATABASE ACCESSION NUMBER: NCBI ACCESSION: NZ_LR135782.1
  ref <309>: DATABASE ENTRY DATE: 2019-04-01
  ref <313>: RELEVANT RESIDUES IN SEQ ID NO: (1)..(1568)
ttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3564 - DNA, 1565 bp, Enterococcus gallinarum
  ref <308>: DATABASE ACCESSION NUMBER: NCBI ACCESSION: NZ_UFYW01000001.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccatcgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3565 - DNA, 1568 bp, Enterococcus gilvus
  ref <308>: DATABASE ACCESSION NUMBER: NCBI ACCESSION: NZ_CP030932.1
  ref <309>: DATABASE ENTRY DATE: 2019-04-01
  ref <313>: RELEVANT RESIDUES IN SEQ ID NO: (1)..(1568)
ttatatgagagtttgatcctggctcaggacgaacgctggcggcgtgcctaatacatgcaagtcgaacgctttttctttcaccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3566 - DNA, 1566 bp, Enterococcus haemoperoxidus
  ref <308>: DATABASE ACCESSION NUMBER: NCBI ACCESSION: NZ_JXKS01000009.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcaattgaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3567 - DNA, 1540 bp, Enterococcus hermanniensis
  ref <308>: DATABASE ACCESSION NUMBER: NCBI ACCESSION: NZ_JXKQ01000033.1
  ref <309>: DATABASE ENTRY DATE: 2019-04-01
  ref <313>: RELEVANT RESIDUES IN SEQ ID NO: (1)..(1540)
tttttatgagagtttgatcctggctcaggacgaacgctggcggcgtgcctaatacatgcaagtcgaacgctttttctttcaccggagcttgctccaccgaaagaaaaagagtggcgaacgggtgagtaacacgtggataacctaccctcaagcgggggataacacttggaaacaggtgctaataccgcataacaaagaaaaccgcatggttttcttttgaaaggcgcttttgcgtcacttgaggatggatccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcaaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttatggagccagccgcctaaggtgggatagatgattggggtgaagtcgtaacaaggtagccgtatcggaagg

SEQ ID NO: 3568 - DNA, 1568 bp, Enterococcus hirae
  ref <308>: DATABASE ACCESSION NUMBER: NCBI ACCESSION: NZ_LR134297.1
  ref <309>: DATABASE ENTRY DATE: 2019-04-01
  ref <313>: RELEVANT RESIDUES IN SEQ ID NO: (1)..(1568)
ttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggcgacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgactgtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcaaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3569 - DNA, 1565 bp, Enterococcus italicus
  ref <308>: DATABASE ACCESSION NUMBER: NCBI ACCESSION: NZ_JXKT01000086.1
  ref <309>: DATABASE ENTRY DATE: 2019-04-01
  ref <313>: RELEVANT RESIDUES IN SEQ ID NO: (1)..(1565)
tttttatgagagtttgatcctggctcaggacgaacgctggcggcgtgcctaatacatgcaagttgaacgcttctttcttatcgaacttcggttcaccaagaaagaagagtagcgaacgggtgagtaacacgtgggtaacctgcccatcagcgggggataacacttggaaacaggtgctaataccgcataatactttttctctcatgagtgaaagttgaaaggcgcttttgcgtcactgatggatggacccgcggtgcattagctagttggtagggtaacggcctaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagaagagaatgttcatcccttgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaagga

SEQ ID NO: 3570 - DNA, 1567 bp, Enterococcus malodoratus
  ref <308>: DATABASE ACCESSION NUMBER: NCBI ACCESSION: NZ_UFXU01000002.1
  ref <309>: DATABASE ENTRY DATE: 2019-04-01
  ref <313>: RELEVANT RESIDUES IN SEQ ID NO: (1)..(1567)
ttttatgagagtttgatcctggctcaggacgaacgctggcggcgtgcctaatacatgcaagtcgaacgctttttctttcaccggagcttgctccatcgaaagaaaaggagtggcgaacgggtgagtaacacgtgggtaacctgcccatcagaaggggataacacttggaaacaggtgctaataccgtataacagtagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3571 - DNA, 1565 bp, Enterococcus massiliensis
  ref <308>: DATABASE ACCESSION NUMBER: NCBI ACCESSION: NZ_CVRN01000003.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccgagatttatctcaccgaaagaaaaagagtggcgaacgggtgagtaacacgtgggtaacctgcccatcagcggaggataacacttggaaacaggtgctaatactgcataatacgaaggatcacatggtctttcgttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagaagagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3572 - DNA, 1566 bp, Enterococcus moraviensis
  ref <308>: DATABASE ACCESSION NUMBER: NCBI ACCESSION: NZ_JXKW01000028.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3573 - DNA, 1566 bp, Enterococcus mundtii
  ref <308>: DATABASE ACCESSION NUMBER: NCBI ACCESSION: NZ_UFYG01000001.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttcccaccggagcttgctccaccgggaaaagaggagtggcgaacgggtgagtaacacgtgggtaacctgcccatcagaaggggataacacttggaaacaggtgctaataccgtataacaatcgaaaccgcatggtttcgttttgaaaggcgctttacggtgccgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaagggtgagagtaactgttcaccccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3574 - DNA, 1567 bp, Enterococcus pallens
  ref <308>: DATABASE ACCESSION NUMBER: NCBI ACCESSION: NZ_JXKX01000115.1
  ref <309>: DATABASE ENTRY DATE: 2019-04-01
  ref <313>: RELEVANT RESIDUES IN SEQ ID NO: (1)..(1567)
tttttatgagagtttgatcctggctcaggacgaacgctggcggcgtgcctaatacatgcaagtcgaacgctttttcttccaccggagcttgctccaccggaagaaaaggagtggcgaacgggtgagtaacacgtgggtaacctaccctcgagcgggggataacacttggaaacaggtgctaataccgcataacaaagaaaaccgcatggttttcttttgaaaggcgcttttgcgtcactcgaggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaagggtgagagtagaaagttcaccccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaagga

SEQ ID NO: 3575 - DNA, 1566 bp, Enterococcus pernyi
  ref <308>: DATABASE ACCESSION NUMBER: NCBI ACCESSION: NZ_KV388085.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttcccaccggagcttgctccaccgggaaaagaggagtggcgaacgggtgagtaacacgtgggtaacctgcccatcagaaggggataacacttggaaacaggtgctaataccgtataacaatcgaaaccgcatggtttcgttttgaaaggcgctttacggtgccgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaagggtgagagtaactgttcaccccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcgaagtcgtgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3576 - DNA, 1446 bp, Enterococcus phoeniculicola
  ref <308>: DATABASE ACCESSION NUMBER: NCBI ACCESSION: NZ_JXKY01000061.1
  ref <309>: DATABASE ENTRY DATE: 2019-04-01
  ref <313>: RELEVANT RESIDUES IN SEQ ID NO: (1)..(1446)
gagtaacacgtgggtaacctgcccatcagaaggggataacacttggaaacaggtgctaataccgtataacaattggaaccgcatggttctaatttgaaagacgctttcgggtgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcaaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagccggtgaggtaaccttttggagccagccgtctaaggtgggatagatgattggggtgaagtcgtaacaaggtagccgtatcggaaggtgcggctggatcacctcctttctaaggaa

SEQ ID NO: 3577 - DNA, 1566 bp, Enterococcus plantarum
  ref <308>: DATABASE ACCESSION NUMBER: NCBI ACCESSION: NZ_PIEU01000131.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3578 - DNA, 1567 bp, Enterococcus pseudoavium
  ref <308>: DATABASE ACCESSION NUMBER: NCBI ACCESSION: NZ_NNBZ01000001.1
  ref <309>: DATABASE ENTRY DATE: 2019-04-01
  ref <313>: RELEVANT RESIDUES IN SEQ ID NO: (1)..(1567)
ttatatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggcgctaataccgtataacaagtaaaaccgcatggttttactttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccaaccgcctaaggtgggatagatgattggggtgaagtcgtaacaaggtagccgtatcggaaggtgcggctggatcacctcctttctaaggaa

SEQ ID NO: 3579 - DNA, 1075 bp, Enterococcus quebecensis
  ref <308>: DATABASE ACCESSION NUMBER: NCBI ACCESSION: NZ_JXKZ01000034.1
  ref <309>: DATABASE ENTRY DATE: 2019-04-01
  ref <313>: RELEVANT RESIDUES IN SEQ ID NO: (1)..(1075)
ccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3580 - DNA, 1327 bp, Enterococcus raffinosus
  ref <308>: DATABASE ACCESSION NUMBER: NCBI ACCESSION: NZ_JXLA01000101.1
  ref <309>: DATABASE ENTRY DATE: 2019-04-01
  ref <313>: RELEVANT RESIDUES IN SEQ ID NO: (1)..(1327)
tggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3581 - DNA, 1569 bp, Enterococcus ratti
  ref <308>: DATABASE ACCESSION NUMBER: NCBI ACCESSION: NZ_JXLB01000051.1
  ref <309>: DATABASE ENTRY DATE: 2019-04-01
  ref <313>: RELEVANT RESIDUES IN SEQ ID NO: (1)..(1569)
tttttatgagagtttgatcctggctcaggacgaacgctggcggcgtgcctaatacatgcaagtcgaacgcttctttttccaccggagcttgctccaccggaaaaagaagagtggcgaacgggtgagtaacacgtgggtaacctacccatcagaaggggataacacttggaaacaggtgctaataccgtataacaatcaaaaccgcatggttttgatttgaaagacgctttcgggtgtcactgatggatggacctgcggtgcattagctagttggtgaggtaacggctcaccaaggcgacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgatcgctctagagatagagtttccccttcgggggcaaagtgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggtggggatgacgtcaaatcatcatgccccttatgacctgggctacacacgtgctacaatgggaagtacaacgagtagcgaagtcgcaaggctaagcgaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccgtttggagccagccgcctaaggtgggatagatgattggggtgaagtcgtaacaaggtagccgtatcggaaggtgcggctggatcacctcctttctaaggaa

SEQ ID NO: 3582 - DNA, 1566 bp, Enterococcus rivorum
  ref <308>: DATABASE ACCESSION NUMBER: NCBI ACCESSION: NZ_MIEK01000071.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttctttccttccgagtgcttgcactcaactggaaagaggagtggcggacgggtgagtaacacgtgggtaacctacccatcagagggggataacacttggaaacaggtgctaataccgcataacagtctgtaccgcatggtacaggagtgaaagacgctttcgggtgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttatggagccagccgcctaaggtgggatagatgattggggtgaagtcgtaacaaggtagccgtatcggaaggtgcggctggatcacctcctttctaaggaa

SEQ ID NO: 3583 - DNA, 1468 bp, Enterococcus saccharolyticus
  ref <308>: DATABASE ACCESSION NUMBER: NCBI ACCESSION: NZ_JXLD01000036.1
  ref <309>: DATABASE ENTRY DATE: 2019-04-01
  ref <313>: RELEVANT RESIDUES IN SEQ ID NO: (1)..(1468)
aaaagaggagtggcgaacgggtgagtaacacgtgggtaacctgcccatcagagggggataacacttggaaacaggtgctaataccgcataatgctttttctcgcatgagagaaagctgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagaagagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccctattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3584 - DNA, 1537 bp, Enterococcus silesiacus
  ref <308>: DATABASE ACCESSION NUMBER: NCBI ACCESSION: NZ_JXLC01000053.1
  ref <309>: DATABASE ENTRY DATE: 2019-04-01
  ref <313>: RELEVANT RESIDUES IN SEQ ID NO: (1)..(1537)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaagg

SEQ ID NO: 3585 - DNA, 1173 bp, Enterococcus sp. 10A9 DIV0425
  ref <308>: DATABASE ACCESSION NUMBER: NCBI ACCESSION: NZ_NGMO01000005.1
  ref <309>: DATABASE ENTRY DATE: 2019-04-01
  ref <313>: RELEVANT RESIDUES IN SEQ ID NO: (1)..(1173)
tatgagagtttgatcctggctcaggacgaacgctggcggcgtgcctaatacatgcaagtcgaacgcttctttttccaccggagcttgctccatcggaaaaagaggagtggcgaacgggtgagtaacacgtgggtaacctgcccatcagaaggggataacacttggaaacaggtgctaataccgtataacaatcgaaaccgcatggttttgatttgaaaggcgctttacggtgccgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagac

SEQ ID NO: 3586 - DNA, 1569 bp, Enterococcus sp. 10F3 DIV0382
  ref <308>: DATABASE ACCESSION NUMBER: NCBI ACCESSION: NZ_NGMF01000007.1
  ref <309>: DATABASE ENTRY DATE: 2019-04-01
  ref <313>: RELEVANT RESIDUES IN SEQ ID NO: (1)..(1569)
tttttatgagagtttgatcctggctcaggacgaacgctggcggcgtgcctaatacatgcaagtcgtacgcttctttttccaccggagcttgctccactggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccaccattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3587 - DNA, 1566 bp, Enterococcus sp. 1140 ESPC; identical to SEQ ID NO: 3562
  ref <308>: DATABASE ACCESSION NUMBER: NCBI ACCESSION: NZ_JWBQ01000075.1
  ref <309>: DATABASE ENTRY DATE: 2019-04-01
  ref <313>: RELEVANT RESIDUES IN SEQ ID NO: (1)..(1566)

SEQ ID NO: 3588 - DNA, 1566 bp, Enterococcus sp. 12C11 DIV0727
  ref <308>: DATABASE ACCESSION NUMBER: NCBI ACCESSION: NZ_NGLZ01000001.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataacagtcgacaccgcatggtgttgatttgaaaggcgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaataagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgcttgagagatcaagtcttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3589 - DNA, 1290 bp, Enterococcus sp. 12E11 DIV0728
  ref <308>: DATABASE ACCESSION NUMBER: NCBI ACCESSION: NZ_NGLY01000006.1
  ref <309>: DATABASE ENTRY DATE: 2019-04-01
  ref <313>: RELEVANT RESIDUES IN SEQ ID NO: (1)..(1290)
ttatatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggct

SEQ ID NO: 3590 - DNA, 1568 bp, Enterococcus sp. 12F9 DIV0723
  ref <308>: DATABASE ACCESSION NUMBER: NCBI ACCESSION: NZ_NIBK01000003.1
  ref <309>: DATABASE ENTRY DATE: 2019-04-01
  ref <313>: RELEVANT RESIDUES IN SEQ ID NO: (1)..(1568)
tttatatgagagtttgatcctggctcaggacgaacgctggcggcgtgcctaatacatgcaagtcgaacgctttttctttcaccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3591 - DNA, 1566 bp, Enterococcus sp. 255 ESPC; identical to SEQ ID NO: 3562
  ref <308>: DATABASE ACCESSION NUMBER: NCBI ACCESSION: NZ_JVOE01000084.1
  ref <309>: DATABASE ENTRY DATE: 2019-04-01
  ref <313>: RELEVANT RESIDUES IN SEQ ID NO: (1)..(1566)

SEQ ID NO: 3592 - DNA, 607 bp, Enterococcus sp. 2F9 DIV0599
  ref <308>: DATABASE ACCESSION NUMBER: NCBI ACCESSION: NZ_NGLN01000015.1
  ref <309>: DATABASE ENTRY DATE: 2019-04-01
  ref <313>: RELEVANT RESIDUES IN SEQ ID NO: (1)..(607)
ggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3593 - DNA, 1565 bp, Enterococcus sp. 2G9 DIV0600
  ref <308>: DATABASE ACCESSION NUMBER: NCBI ACCESSION: NZ_NGLL01000001.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3594 - DNA, 1565 bp, Enterococcus sp. 3C7 DIV0644
  ref <308>: DATABASE ACCESSION NUMBER: NCBI ACCESSION: NZ_NGLK01000001.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3595 - DNA, 1565 bp, Enterococcus sp. 3C8 DIV0646; identical to SEQ ID NO: 3594
  ref <308>: DATABASE ACCESSION NUMBER: NCBI ACCESSION: NZ_NGLJ01000001.1
  ref <309>: DATABASE ENTRY DATE: 2019-04-01
  ref <313>: RELEVANT RESIDUES IN SEQ ID NO: (1)..(1565)

SEQ ID NO: 3596 - DNA, 1570 bp, Enterococcus sp. 3G1 DIV0629
  ref <308>: DATABASE ACCESSION NUMBER: NCBI ACCESSION: NZ_NGLI01000001.1
  ref <309>: DATABASE ENTRY DATE: 2019-04-01
  ref <313>: RELEVANT RESIDUES IN SEQ ID NO: (1)..(1570)
tttttatgagagtttgatcctggctcaggacgaacgctggcggcgtgcctaatacatgcaagtcgtacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtaaggtaacctttttggagccagccgcctaaggtgggatagatgattggggtgaagtcgtaacaaggtagccgtatcggaaggtgcggctggatcacctcctttctaaggaa

SEQ ID NO: 3597 - DNA, 1566 bp, Enterococcus sp. 3G6 DIV0642
  ref <308>: DATABASE ACCESSION NUMBER: NCBI ACCESSION: NZ_NGLH01000001.1
  ref <309>: DATABASE ENTRY DATE: 2019-04-01
  ref <313>: RELEVANT RESIDUES IN SEQ ID NO: (1)..(1566)
ttatgagagtttgatcctggctcaggacgaacgctggcggcgtgcctaatacatgcaagtcgaacgcttttcctttcatcggagcttgctccaccgaaaggaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3598 - DNA, 1565 bp, Enterococcus sp. 4E1 DIV0656; identical to SEQ ID NO: 3556
  ref <308>: DATABASE ACCESSION NUMBER: NCBI ACCESSION: NZ_NGLF01000001.1
  ref <309>: DATABASE ENTRY DATE: 2019-04-01
  ref <313>: RELEVANT RESIDUES IN SEQ ID NO: (1)..(1565)

SEQ ID NO: 3599 - DNA, 1566 bp, Enterococcus sp. 4G2 DIV0659
  ref <308>: DATABASE ACCESSION NUMBER: NCBI ACCESSION: NZ_NGLE01000002.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagtgggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3600 - DNA, 1565 bp, Enterococcus sp. 5B3 DIV0040
  ref <308>: DATABASE ACCESSION NUMBER: NCBI ACCESSION: NZ_NGLC01000001.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactatcttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3601 - DNA, 1566 bp, Enterococcus sp. 5B7 DIV0075
  ref <308>: DATABASE ACCESSION NUMBER: NCBI ACCESSION: NZ_NGMR01000001.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgtacgctttttctttcaccggagcttgctccaccgaaagaaaaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3602 - DNA, 1567 bp, Enterococcus sp. 6C8 DIV0013
  ref <308>: DATABASE ACCESSION NUMBER: NCBI ACCESSION: NZ_NGMT01000001.1
  ref <309>: DATABASE ENTRY DATE: 2019-04-01
  ref <313>: RELEVANT RESIDUES IN SEQ ID NO: (1)..(1567)
ttttattgagagtttgatcctggctcaggacgaacgctggcggcgtgcctaatacatgcaagtcgaacgctttgattttcaccggagcttgctccaccgaaaatcaaagagtggcggacgggtgagtaacacgtgggcaacctgcccaacagagggggataacacttggaaacaggtgctaataccgcataatttgttttcctgcatgggagaataataaaagacgcttcggtgtcactgttggatgggcccgcgctgcattagttagttggtggggtaatggcctaccaagactgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgggagagtaactgttcccaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagccctcggctcaaccgaggaaggtcattggaaactggggaacttgaatgcagaagaggagagtggaattccatgtgtagcggtgaaatgcgtagatatatggaggaacaccagtggcgaaggcgactctctggtctgtaattgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatggacggtacaatgagtcgcgagaccgcgaggtttagctaatctcttaaagccgttctcagttcggattgtaggctgcaactcgcctacatgaagccggaatcgctagtaatcgtggatcagcacgccacggtgaatacgttcccgggccttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3603 - DNA, 1565 bp, Enterococcus sp. 6D12 DIV0197; identical to SEQ ID NO: 3593
  ref <308>: DATABASE ACCESSION NUMBER: NCBI ACCESSION: NZ_NIBN01000001.1
  ref <309>: DATABASE ENTRY DATE: 2019-04-01
  ref <313>: RELEVANT RESIDUES IN SEQ ID NO: (1)..(1565)

SEQ ID NO: 3604 - DNA, 1566 bp, Enterococcus sp. 7D2 DIV0200
  ref <308>: DATABASE ACCESSION NUMBER: NCBI ACCESSION: NZ_NGNB01000001.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataacagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaataagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgcttgagagatcaagtcttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3605 - DNA, 1566 bp, Enterococcus sp. 7E2 DIV0204
  ref <308>: DATABASE ACCESSION NUMBER: NCBI ACCESSION: NZ_NGKY01000001.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagaggggaataacacttggaaacaggtgctaataccgcataacagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgcttgagagatcaagtcttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3606 - DNA, 1566 bp, Enterococcus sp. 7F3 DIV0205
  ref <308>: DATABASE ACCESSION NUMBER: NCBI ACCESSION: NZ_NGKX01000001.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataacagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3607 - DNA, 1565 bp, Enterococcus sp. 8E11 MSG4843; identical to SEQ ID NO: 3556
  ref <308>: DATABASE ACCESSION NUMBER: NCBI ACCESSION: NZ_NIBP01000002.1
  ref <309>: DATABASE ENTRY DATE: 2019-04-01
  ref <313>: RELEVANT RESIDUES IN SEQ ID NO: (1)..(1565)

SEQ ID NO: 3608 - DNA, 1565 bp, Enterococcus sp. 8G7 MSG3316
  ref <308>: DATABASE ACCESSION NUMBER: NCBI ACCESSION: NZ_NGKU01000001.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3609 - DNA, 1566 bp, Enterococcus sp. 9D6 DIV0238
  ref <308>: DATABASE ACCESSION NUMBER: NCBI ACCESSION: NZ_NIBQ01000004.1
  ref <309>: DATABASE ENTRY DATE: 2019-04-01
  ref <313>: RELEVANT RESIDUES IN SEQ ID NO: (1)..(1566)
ttatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctgcccatcagagggggataacacttggaaacaggtgctaataccgcataacagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcctccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3610 - DNA, 1569 bp, Enterococcus sp. 9E7 DIV0242
  ref <308>: DATABASE ACCESSION NUMBER: NCBI ACCESSION: NZ_NGMM01000009.1
  ref <309>: DATABASE ENTRY DATE: 2019-04-01
  ref <313>: RELEVANT RESIDUES IN SEQ ID NO: (1)..(1569)
tttttatgagagtttgatcctggctcaggacgaacgctggcggcgtgcctaatacatgcaagtcgaacgcttcttttccaccgagtgcttgcactcaccggaaaagaggagtggcggacgggtgagtaacacgtgggtaacctgcccatcagaaggggataacacttggaaacaggtgctaataccgtataacaatcggaaccgcatggttctgatttgaaaggcgctttcgggtgtcgctgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3611 - DNA, 1565 bp, Enterococcus sp. C1; identical to SEQ ID NO: 3556
  ref <308>: DATABASE ACCESSION NUMBER: NCBI ACCESSION: NZ_AKKS01000001.1
  ref <309>: DATABASE ENTRY DATE: 2019-04-01
  ref <313>: RELEVANT RESIDUES IN SEQ ID NO: (1)..(1565)

SEQ ID NO: 3612 - DNA, 1565 bp, Enterococcus sp. CR-Ec1
  ref <308>: DATABASE ACCESSION NUMBER: NCBI ACCESSION: NZ_CP025223.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccatcgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3613 - DNA, 1565 bp, Enterococcus sp. FDAARGOS 375; identical to SEQ ID NO: 3593
  ref <308>: DATABASE ACCESSION NUMBER: NCBI ACCESSION: NZ_CP023515.1
  ref <309>: DATABASE ENTRY DATE: 2019-04-01
  ref <313>: RELEVANT RESIDUES IN SEQ ID NO: (1)..(1565)

SEQ ID NO: 3614 - DNA, 1565 bp, Enterococcus sp. FDAARGOS 553
  ref <308>: DATABASE ACCESSION NUMBER: NCBI ACCESSION: NZ_CP033740.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3615 - DNA, 827 bp, Enterococcus sp. GMD1E
  ref <308>: DATABASE ACCESSION NUMBER: NCBI ACCESSION: NZ_AJQX01000213.1
  ref <309>: DATABASE ENTRY DATE: 2019-04-01
  ref <313>: RELEVANT RESIDUES IN SEQ ID NO: (1)..(827)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtgactgttcatcccttgacggtatctaaccagaaagccacggctaactacgtgccagcagccgcggtaatacgtaggtggcaagcgttgtccggatttattggggtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacg

SEQ ID NO: 3616 - DNA, 1472 bp, Enterococcus sp. GMD2E
  ref <308>: DATABASE ACCESSION NUMBER: NCBI ACCESSION: NZ_AJQZ01000100.1
  ref <309>: DATABASE ENTRY DATE: 2019-04-01
  ref <313>: RELEVANT RESIDUES IN SEQ ID NO: (1)..(1472)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 3617 - DNA, 1472 bp, Enterococcus sp. GMD3E; identical to SEQ ID NO: 3616
  ref <308>: DATABASE ACCESSION NUMBER: NCBI ACCESSION: NZ_AJRB03000092.1
  ref <309>: DATABASE ENTRY DATE: 2019-04-01
  ref <313>: RELEVANT RESIDUES IN SEQ ID NO: (1)..(1472)

SEQ ID NO: 3618 - DNA, 1472 bp, Enterococcus sp. GMD4E; identical to SEQ ID NO: 3616
  ref <308>: DATABASE ACCESSION NUMBER: NCBI ACCESSION: NZ_AJRD01000095.1
  ref <309>: DATABASE ENTRY DATE: 2019-04-01
  ref <313>: RELEVANT RESIDUES IN SEQ ID NO: (1)..(1472)

SEQ ID NO: 3619 - DNA, 1472 bp, Enterococcus sp. GMD5E; identical to SEQ ID NO: 3616
  ref <308>: DATABASE ACCESSION NUMBER: NCBI ACCESSION: NZ_AJRF02000002.1
  ref <309>: DATABASE ENTRY DATE: 2019-04-01
  ref <313>: RELEVANT RESIDUES IN SEQ ID NO: (1)..(1472)

SEQ ID NO: 3620 - DNA, 1471 bp, Enterococcus sp. H57
  ref <308>: DATABASE ACCESSION NUMBER: NCBI ACCESSION: NZ_BEHC01000013.1
  ref <309>: DATABASE ENTRY DATE: 2019-04-01
  ref <313>: RELEVANT RESIDUES IN SEQ ID NO: (1)..(1471)
ttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 3621 - DNA, 1569 bp, Enterococcus sp. HMSC034B11
  ref <308>: DATABASE ACCESSION NUMBER: NCBI ACCESSION: NZ_KV826047.1
  ref <309>: DATABASE ENTRY DATE: 2019-04-01
  ref <313>: RELEVANT RESIDUES IN SEQ ID NO: (1)..(1569)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3622 - DNA, 1472 bp, Enterococcus sp. HMSC035B04; identical to SEQ ID NO: 3616
  ref <308>: DATABASE ACCESSION NUMBER: NCBI ACCESSION: NZ_KV826681.1
  ref <309>: DATABASE ENTRY DATE: 2019-04-01
  ref <313>: RELEVANT RESIDUES IN SEQ ID NO: (1)..(1472)

SEQ ID NO: 3623 - DNA, 1472 bp, Enterococcus sp. HMSC035C10; identical to SEQ ID NO: 3616
  ref <308>: DATABASE ACCESSION NUMBER: NCBI ACCESSION: NZ_KV827166.1
  ref <309>: DATABASE ENTRY DATE: 2019-04-01
  ref <313>: RELEVANT RESIDUES IN SEQ ID NO: (1)..(1472)

SEQ ID NO: 3624 - DNA, 1472 bp, Enterococcus sp. HMSC055G03
  ref <308>: DATABASE ACCESSION NUMBER: NCBI ACCESSION: NZ_KV805364.1
  ref <309>: DATABASE ENTRY DATE: 2019-04-01
  ref <313>: RELEVANT RESIDUES IN SEQ ID NO: (1)..(1472)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 3625 - DNA, 842 bp, Enterococcus sp. HMSC056C08
  ref <308>: DATABASE ACCESSION NUMBER: NCBI ACCESSION: NZ_KV796369.1
  ref <309>: DATABASE ENTRY DATE: 2019-04-01
  ref <313>: RELEVANT RESIDUES IN SEQ ID NO: (1)..(842)
ccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 3626 - DNA, 1569 bp, Enterococcus sp. HMSC058D07
  ref <308>: DATABASE ACCESSION NUMBER: NCBI ACCESSION: NZ_KV802840.1
  ref <309>: DATABASE ENTRY DATE: 2019-04-01
  ref <313>: RELEVANT RESIDUES IN SEQ ID NO: (1)..(1569)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3627 - DNA, 1086 bp, Enterococcus sp. HMSC05C03
  ref <308>: DATABASE ACCESSION NUMBER: NCBI ACCESSION: NZ_KV788096.1
  ref <309>: DATABASE ENTRY DATE: 2019-04-01
  ref <313>: RELEVANT RESIDUES IN SEQ ID NO: (1)..(1086)
agaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3628 - DNA, 1233 bp, Enterococcus sp. HMSC060D07
  ref <308>: DATABASE ACCESSION NUMBER: NCBI ACCESSION: NZ_KV829265.1
  ref <309>: DATABASE ENTRY DATE: 2019-04-01
  ref <313>: RELEVANT RESIDUES IN SEQ ID NO: (1)..(1233)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttat

SEQ ID NO: 3629 - DNA, 1233 bp, Enterococcus sp. HMSC060D09
  ref <308>: DATABASE ACCESSION NUMBER: NCBI ACCESSION: NZ_KV829550.1
  ref <309>: DATABASE ENTRY DATE: 2019-04-01
  ref <313>: RELEVANT RESIDUES IN SEQ ID NO: (1)..(1233)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttat

SEQ ID NO: 3630 - DNA, 1233 bp, Enterococcus sp. HMSC060E05; identical to SEQ ID NO: 3629
  ref <308>: DATABASE ACCESSION NUMBER: NCBI ACCESSION: NZ_KV816791.1
  ref <309>: DATABASE ENTRY DATE: 2019-04-01
  ref <313>: RELEVANT RESIDUES IN SEQ ID NO: (1)..(1233)

SEQ ID NO: 3631 - DNA, 1570 bp, Enterococcus sp. HMSC061C05
  ref <308>: DATABASE ACCESSION NUMBER: NCBI ACCESSION: NZ_KV817735.1
  ref <309>: DATABASE ENTRY DATE: 2019-04-01
  ref <313>: RELEVANT RESIDUES IN SEQ ID NO: (1)..(1570)
tttttatgagagtttgatcctggctcaggacgaacgctggcggcgtgcctaatacatgcaagtcgtacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3632 - DNA, 1472 bp, Enterococcus sp. HMSC063C12; identical to SEQ ID NO: 3624
  ref <308>: DATABASE ACCESSION NUMBER: NCBI ACCESSION: NZ_KV815798.1
  ref <309>: DATABASE ENTRY DATE: 2019-04-01
  ref <313>: RELEVANT RESIDUES IN SEQ ID NO: (1)..(1472)

SEQ ID NO: 3633 - DNA, 1570 bp, Enterococcus sp. HMSC063D12; identical to SEQ ID NO: 3631
  ref <308>: DATABASE ACCESSION NUMBER: NCBI ACCESSION: NZ_KV795265.1
  ref <309>: DATABASE ENTRY DATE: 2019-04-01
  ref <313>: RELEVANT RESIDUES IN SEQ ID NO: (1)..(1570)

SEQ ID NO: 3634 - DNA, 1472 bp, Enterococcus sp. HMSC063H10; identical to SEQ ID NO: 3624
  ref <308>: DATABASE ACCESSION NUMBER: NCBI ACCESSION: NZ_KV804032.1
  ref <309>: DATABASE ENTRY DATE: 2019-04-01
  ref <313>: RELEVANT RESIDUES IN SEQ ID NO: (1)..(1472)

SEQ ID NO: 3635 - DNA, 1548 bp, Enterococcus sp. HMSC064A12
  ref <308>: DATABASE ACCESSION NUMBER: NCBI ACCESSION: NZ_KV795196.1
  ref <309>: DATABASE ENTRY DATE: 2019-04-01
  ref <313>: RELEVANT RESIDUES IN SEQ ID NO: (1)..(1548)
tttttatgagagtttgatcctggctcaggacgaacgctggcggcgtgcctaatacatgcaagtcgaacgctttttctttcaccggagcttgctccaccgaaagaaaaggagtggcgaacgggtgagtaacacgtgggtaacctgcccatcagaaggggataacacttggaaacaggtgctaataccgtataacaatcgaaaccgcatggtttcggtttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgcaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctgg

SEQ ID NO: 3636 - DNA, 1472 bp, Enterococcus sp. HMSC065H03; identical to SEQ ID NO: 3616
  ref <308>: DATABASE ACCESSION NUMBER: NCBI ACCESSION: NZ_KV818999.1
  ref <309>: DATABASE ENTRY DATE: 2019-04-01
  ref <313>: RELEVANT RESIDUES IN SEQ ID NO: (1)..(1472)

SEQ ID NO: 3637 - DNA, 881 bp, Enterococcus sp. HMSC065H12
  ref <308>: DATABASE ACCESSION NUMBER: NCBI ACCESSION: NZ_KV812951.1
  ref <309>: DATABASE ENTRY DATE: 2019-04-01
  ref <313>: RELEVANT RESIDUES IN SEQ ID NO: (1)..(881)
gtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacg

SEQ ID NO: 3638 - DNA, 1568 bp, Enterococcus sp. HMSC066C04
  ref <308>: DATABASE ACCESSION NUMBER: NCBI ACCESSION: NZ_KV818767.1
  ref <309>: DATABASE ENTRY DATE: 2019-04-01
  ref <313>: RELEVANT RESIDUES IN SEQ ID NO: (1)..(1568)
tttttatgagagtttgatcctggctcaggacgaacgctggcggcgtgcctaatacatgcaagtcgaacgccttttctttcaccggagcttgctccaccgaaagaaaaggagtggcgaacgggtgagtaacacgtgggtaacctgcccatcagaaggggataacacttggaaacaggtgctaataccgtataacaatagaaaccgcatggtttctatttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3639 - DNA, 1570 bp, Enterococcus sp. HMSC067C01
  ref <308>: DATABASE ACCESSION NUMBER: NCBI ACCESSION: NZ_KV809634.1
  ref <309>: DATABASE ENTRY DATE: 2019-04-01
  ref <313>: RELEVANT RESIDUES IN SEQ ID NO: (1)..(1570)
tttttatgagagtttgatcctggctcaggacgaacgctggcggcgtgcctaatacatgcaagtcgtacgcttctttttccaccggagcttgctccaccggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3640 - DNA, 1391 bp, Enterococcus sp. HMSC069A01
  ref <308>: DATABASE ACCESSION NUMBER: NCBI ACCESSION: NZ_KV798470.1
  ref <309>: DATABASE ENTRY DATE: 2019-04-01
  ref <313>: RELEVANT RESIDUES IN SEQ ID NO: (1)..(1391)
ccggagcttgctccaccggaaaaagaggagtggcgaacgggtgagtaacacgtgggtaacctgcccatcagaaggggataacacttggaaacaggtgctaataccgtataacaatcaaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 3641 - DNA, 1569 bp, Enterococcus sp. HMSC070F12; identical to SEQ ID NO: 3621
  ref <308>: DATABASE ACCESSION NUMBER: NCBI ACCESSION: NZ_KV833142.1
  ref <309>: DATABASE ENTRY DATE: 2019-04-01
  ref <313>: RELEVANT RESIDUES IN SEQ ID NO: (1)..(1569)

SEQ ID NO: 3642 - DNA, 1472 bp, Enterococcus sp. HMSC072D11; identical to SEQ ID NO: 3616
  ref <308>: DATABASE ACCESSION NUMBER: NCBI ACCESSION: NZ_KV833672.1
  ref <309>: DATABASE ENTRY DATE: 2019-04-01
  ref <313>: RELEVANT RESIDUES IN SEQ ID NO: (1)..(1472)

SEQ ID NO: 3643 - DNA, 1472 bp, Enterococcus sp. HMSC072F02
  ref <308>: DATABASE ACCESSION NUMBER: NCBI ACCESSION: NZ_KV833936.1
  ref <309>: DATABASE ENTRY DATE: 2019-04-01
  ref <313>: RELEVANT RESIDUES IN SEQ ID NO: (1)..(1472)
tttttatgagagtttgatcctggctcaggacgaacgctggcggcgtgcctaatacatgcaagtcgtacgcttctttttccaccggagcttgctccaccggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttt

SEQ ID NO: 3644 - DNA, 1472 bp, Enterococcus sp. HMSC072F07; identical to SEQ ID NO: 3616
  ref <308>: DATABASE ACCESSION NUMBER: NCBI ACCESSION: NZ_KV809888.1
  ref <309>: DATABASE ENTRY DATE: 2019-04-01
  ref <313>: RELEVANT RESIDUES IN SEQ ID NO: (1)..(1472)

SEQ ID NO: 3645 - DNA, 1472 bp, Enterococcus sp. HMSC072G01; identical to SEQ ID NO: 3616
  ref <308>: DATABASE ACCESSION NUMBER: NCBI ACCESSION: NZ_KV795949.1
  ref <309>: DATABASE ENTRY DATE: 2019-04-01
  ref <313>: RELEVANT RESIDUES IN SEQ ID NO: (1)..(1472)

SEQ ID NO: 3646 - DNA, 1568 bp, Enterococcus sp. HMSC072H05
  ref <308>: DATABASE ACCESSION NUMBER: NCBI ACCESSION: NZ_KV801162.1
  ref <309>: DATABASE ENTRY DATE: 2019-04-01
  ref <313>: RELEVANT RESIDUES IN SEQ ID NO: (1)..(1568)
tttttatgagagtttgatcctggctcaggacgaacgctggcggcgtgcctaatacatgcaagtcgaacgctttttctttcaccggagcttgctccaccgaaagaaaaggagtggcgaacgggtgagtaacacgtgggtaacctgcccatcagaaggggataacacttggaaacaggtgctaataccgtataacaatcgaaaccgcatggtttcggtttgaaaggcgcttttgcgtcactgatggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgcaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3647 - DNA, 1472 bp, Enterococcus sp. HMSC073E07; identical to SEQ ID NO: 3616
  ref <308>: DATABASE ACCESSION NUMBER: NCBI ACCESSION: NZ_KV801938.1
  ref <309>: DATABASE ENTRY DATE: 2019-04-01
  ref <313>: RELEVANT RESIDUES IN SEQ ID NO: (1)..(1472)

SEQ ID NO: 3648 - DNA, 1472 bp, Enterococcus sp. HMSC073E08; identical to SEQ ID NO: 3616
  ref <308>: DATABASE ACCESSION NUMBER: NCBI ACCESSION: NZ_KV806460.1
  ref <309>: DATABASE ENTRY DATE: 2019-04-01
  ref <313>: RELEVANT RESIDUES IN SEQ ID NO: (1)..(1472)

SEQ ID NO: 3649 - DNA, 1566 bp, Enterococcus sp. HMSC073E09; identical to SEQ ID NO: 3562
  ref <308>: DATABASE ACCESSION NUMBER: NCBI ACCESSION: NZ_KV811970.1
  ref <309>: DATABASE ENTRY DATE: 2019-04-01
  ref <313>: RELEVANT RESIDUES IN SEQ ID NO: (1)..(1566)

SEQ ID NO: 3650 - DNA, 1472 bp, Enterococcus sp. HMSC074F07; identical to SEQ ID NO: 3616
  ref <308>: DATABASE ACCESSION NUMBER: NCBI ACCESSION: NZ_KV834511.1
  ref <309>: DATABASE ENTRY DATE: 2019-04-01
  ref <313>: RELEVANT RESIDUES IN SEQ ID NO: (1)..(1472)

SEQ ID NO: 3651 - DNA, 1472 bp, Enterococcus sp. HMSC076D08; identical to SEQ ID NO: 3616
  ref <308>: DATABASE ACCESSION NUMBER: NCBI ACCESSION: NZ_KV819579.1
  ref <309>: DATABASE ENTRY DATE: 2019-04-01
  ref <313>: RELEVANT RESIDUES IN SEQ ID NO: (1)..(1472)

SEQ ID NO: 3652 - DNA, 1570 bp, Enterococcus sp. HMSC076E04
  ref <308>: DATABASE ACCESSION NUMBER: NCBI ACCESSION: NZ_KV815554.1
  ref <309>: DATABASE ENTRY DATE: 2019-04-01
  ref <313>: RELEVANT RESIDUES IN SEQ ID NO: (1)..(1570)
tttttatgagagtttgatcctggctcaggacgaacgctggcggcgtgcctaatacatgcaagtcgtacgcttctttttccaccggagcttgctccaccggaaaaagaggagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaataaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3653 - DNA, 1233 bp, Enterococcus sp. HMSC077E04; identical to SEQ ID NO: 3628
  ref <308>: DATABASE ACCESSION NUMBER: NCBI ACCESSION: NZ_KV797199.1
  ref <309>: DATABASE ENTRY DATE: 2019-04-01
  ref <313>: RELEVANT RESIDUES IN SEQ ID NO: (1)..(1233)

SEQ ID NO: 3654 - DNA, 1233 bp, Enterococcus sp. HMSC077E07; identical to SEQ ID NO: 3629
  ref <308>: DATABASE ACCESSION NUMBER: NCBI ACCESSION: NZ_KV807092.1
  ref <309>: DATABASE ENTRY DATE: 2019-04-01
  ref <313>: RELEVANT RESIDUES IN SEQ ID NO: (1)..(1233)

SEQ ID NO: 3655 - DNA, 1566 bp, Enterococcus sp. HMSC078F03
  ref <308>: DATABASE ACCESSION NUMBER: NCBI ACCESSION: NZ_KV805545.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttctttcctcccgagtgcttgcactcaattggaaagaggagtggcggacgggtgagtaacacgtgggtaacctacccatcagagggggataacacttggaaacaggtgctaataccgcataacagtttatgccgcatggcataagagtgaaaggcgctttcgggtgtcgctgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggacgttagtaactgaacgtcccctgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgctagaccgcgaggtcatgcaaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3656 - DNA, 1214 bp, Enterococcus sp. HMSC14A10
  ref <308>: DATABASE ACCESSION NUMBER: NCBI ACCESSION: NZ_KV787351.1
  ref <309>: DATABASE ENTRY DATE: 2019-04-01
  ref <313>: RELEVANT RESIDUES IN SEQ ID NO: (1)..(1214)
ttttatgagagtttgatcctggctcaggacgaacgctggcggcgtgcctaatacatgcaagtcgaacgctttttctttcatcggagcttgctccaccggaagaaaaggagtggcgaacgggtgagtaacacgtgggtaacctgcccatcagaaggggataacacttggaaacaggtgctaataccgtataacaatagaaaccgcatggtttctatttaaaaggcgcttttgcgtcactggtggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaa

SEQ ID NO: 3657 - DNA, 1568 bp, Enterococcus sp. HMSC29A04
  ref <308>: DATABASE ACCESSION NUMBER: NCBI ACCESSION: NZ_KV786322.1
  ref <309>: DATABASE ENTRY DATE: 2019-04-01
  ref <313>: RELEVANT RESIDUES IN SEQ ID NO: (1)..(1568)
tttttatgagagtttgatcctggctcaggacgaacgctggcggcgtgcctaatacatgcaagtcgaacgccttttctttcatcggagcttgctccaccggaagaaaaggagtggcgaacgggtgagtaacacgtgggtaacctgcccatcagaaggggataacacttggaaacaggtgctaataccgtataacaatagaaaccgcatggtttctatttaaaaggcgcttttgcgtcactggtggatggacccgcggtgcattagctagttggtgaggtaacggctcaccaaggcaacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtagaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggaaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3658 - DNA, 1472 bp, Enterococcus sp. HMSC34G12; identical to SEQ ID NO: 3616
  ref <308>: DATABASE ACCESSION NUMBER: NCBI ACCESSION: NZ_KV837940.1
  ref <309>: DATABASE ENTRY DATE: 2019-04-01
  ref <313>: RELEVANT RESIDUES IN SEQ ID NO: (1)..(1472)

SEQ ID NO: 3659 - DNA, 1569 bp, Enterococcus sp. HPCN18
  ref <308>: DATABASE ACCESSION NUMBER: NCBI ACCESSION: NZ_QMKM01000075.1
  ref <309>: DATABASE ENTRY DATE: 2019-04-01
  ref <313>: RELEVANT RESIDUES IN SEQ ID NO: (1)..(1569)
ttttatgagagtttgatcctggctcaggacgaacgctggcggcgtgcctaatacatgcaagtcgtacgcttctttttccaccggagcttgctccaccggaaaaagaagagtggcgaacgggtgagtaacacgtgggtaacctgcccatcagaaggggataacacttggaaacaggtgctaataccgtataacaatcgaaaccgcatggttttgatttgaaaggcgctttcgggtgtcgctgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgcaggctgcaactcgcctgcatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3660 - DNA, 1568 bp, Enterococcus sp. Marseille-P4358
  ref <308>: DATABASE ACCESSION NUMBER: NCBI ACCESSION: NZ_UWOP01000001.1
  ref <309>: DATABASE ENTRY DATE: 2019-04-01
  ref <313>: RELEVANT RESIDUES IN SEQ ID NO: (1)..(1568)
ttttatgagagtttgatcctggctcaggacgaacgctggcggcgtgcctaatacatgcaagtcgaacgcttctttttccaccgagacttgtctcatcggaaaaagaagagtggcgaacgggtgagtaacacgtgggtaacctgcccatcagaaggggataacacttggaaacaggtgctaataccgtataacaatgttcttcgcatgaaggatatttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3661 - DNA, 1566 bp, Enterococcus sp. TR
  ref <308>: DATABASE ACCESSION NUMBER: NCBI ACCESSION: NZ_AYPQ01000008.1
  ref <309>: DATABASE ENTRY DATE: 2019-04-01
  ref <313>: RELEVANT RESIDUES IN SEQ ID NO: (1)..(1566)
attatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctaccatcagagggggataacacttggaaacaggtgctaataccgcataacagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3662 - DNA, 200 bp, Enterococcus sp. kppr-6
  ref <308>: DATABASE ACCESSION NUMBER: NCBI ACCESSION: NZ_FOHR01000011.1
  ref <309>: DATABASE ENTRY DATE: 2019-04-01
  ref <313>: RELEVANT RESIDUES IN SEQ ID NO: (1)..(200)
tttttatgagagtttgatcctggctcaggacgaacgctggcggcgtgcctaatacatgcaagtcgaacgctttttctttcaccggagcttgctccaccgaaagaaaaggagtggcgaacgggtgagtaacacgtgggtaacctgcccatcagaaggggataacacttggaaacaggtgctaataccgtataacagtagaa

SEQ ID NO: 3663 - DNA, 1566 bp, Enterococcus sulfureus
  ref <308>: DATABASE ACCESSION NUMBER: NCBI ACCESSION: NZ_ASWO01000001.1
  ref <309>: DATABASE ENTRY DATE: 2019-04-01
  ref <313>: RELEVANT RESIDUES IN SEQ ID NO: (1)..(1566)
tttttatgagagtttgatcctggctcaggacgaacgctggcggcgtgcctaatacatgcaagtcgaacgcttcttacttatcgaacttcggttcaccaagtaagaggagtggcgaacgggtgagtaacacgtgggtaacctgcccatcagagggggataacacttggaaacaggtgctaataccgcataattcagtttaccgcatggtagagtgatgaaaggcgcttttgcgtcactgatggatggacccgcggtgcattagctagttggtagggtaatggcctaccaaggcaacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaaaatgttcatcccttgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaaatacaacgagttgcgaagtcgcgaggctaagctaatctcttaaagtttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3664 - DNA, 1566 bp, Enterococcus termitis
  ref <308>: DATABASE ACCESSION NUMBER: NCBI ACCESSION: NZ_NGNA01000002.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataacagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3665 - DNA, 1566 bp, Enterococcus thailandicus
  ref <308>: DATABASE ACCESSION NUMBER: NCBI ACCESSION: NZ_CP023074.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgtacgctttttctttcaccggagcttgctccaccgaaagaaaaggagtggcgaacgggtgagtaacacgtgggtaacctgcccatcagaaggggataacacttggaaacaggtgctaataccgtataacaatcgaaaccgcatggttttgatttgaaaggcgctttcgggtgtcactgatggatggacccgcggtgcattagctagttggtgaggtaacggctcaccaaggccacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacctttttggagccagccgcctaaggtgggatagatgattggggtgaagtcgtaacaaggtagccgtatcggaaggtgcggctggatcacctcctttctaaggaa

SEQ ID NO: 3666 - DNA, 1565 bp, Enterococcus timonensis
  ref <308>: DATABASE ACCESSION NUMBER: NCBI ACCESSION: NZ_FNVY01000003.1
  ref <309>: DATABASE ENTRY DATE: 2019-04-01
  ref <313>: RELEVANT RESIDUES IN SEQ ID NO: (1)..(1565)
ttaatgagagtttgatcctggctcaggacgaacgctggcggcgtgcctaatacatgcaagtcgaacgcaacaaagtcaccggagcttgctccacgactttgttgagtggcggacgggtgagtaacacgtgggtaacctgccctttagtgggggataacatttggaaacagatgctaataccgcataacaattttttccacatggaaagaatttgaaagacgctttacggtgtcactaaaggatggacccgcggtgcattagctagttggtgaggtaacggctcaccaaggctgtgatgcatagccgacctgagagggtgatcggccacactgggactgagatacggcccagactcctacgggaggcagcagtagggaatcttcggcaatggacgaaagtctgaccgagcaacgccgcgtgagtgaagaaggttttcggatcgtaaaactctgttgttagagaagaacaaggataagagtaactgtttatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactggggaacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccgctctagagatagagttttcccttcggggacaaagtgacaggtggtgcatggttgtcgtcagctcgtgtcgtgagatgttgggttaagtcccgcaacgagcgcaacccctattgttagttgccatcattaagttgggcactctagcgagactgccggtgacaaaccggaggaaggtggggatgacgtcaaatcatcatgccccttatgacctgggctacacacgtgctacaatgggaagtacaacgagtcgcgaagtcgcaaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttaggagccagccgcctaaggtgggatagatgattggggtgaagtcgtaacaaggtagccgtatcggaaggtgcggctggatcacctcctttctaaggaa

SEQ ID NO: 3667 - DNA, 1566 bp, Enterococcus ureasiticus
  ref <308>: DATABASE ACCESSION NUMBER: NCBI ACCESSION: NZ_MIJZ01000009.1
  ref <309>: DATABASE ENTRY DATE: 2019-04-01
  ref <313>: RELEVANT RESIDUES IN SEQ ID NO: (1)..(1566)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctacccatcagagggggataacacttggaaacaggtgctaataccgcataatagtcgacaccgcatggtgttgatttgaaagacgctttcgggtgtcactgatggatggacccgcggtgcattagctagttggtgaggtaacggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaataagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactcgagagatcgagctttcccttcggggacaaagtgacaggtggtgcatggttgtcgtcagctcgtgtcgtgagatgttgggttaagtcccgcaacgagcgcaacccctattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaacccttgtggagccagccgcctaaggtgggatagatgattggggtgaagtcgtaacaaggtagccgtatcggaaggtgcggctggatcacctcctttctaaggaa

SEQ ID NO: 3668 - DNA, 552 bp, Enterococcus ureilyticus
  ref <308>: DATABASE ACCESSION NUMBER: NCBI ACCESSION: NZ_NHTL01000062.1
  ref <309>: DATABASE ENTRY DATE: 2019-04-01
  ref <313>: RELEVANT RESIDUES IN SEQ ID NO: (1)..(552)
aagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttga

SEQ ID NO: 3669 - DNA, 1569 bp, Enterococcus villorum
  ref <308>: DATABASE ACCESSION NUMBER: NCBI ACCESSION: NZ_MJEB01000076.1
  ref <309>: DATABASE ENTRY DATE: 2019-04-01
  ref <313>: RELEVANT RESIDUES IN SEQ ID NO: (1)..(1569)
tttttatgagagtttgatcctggctcaggacgaacgctggcggcgtgcctaatacatgcaagtcgaacgcttctttttccaccggagcttgctccaccggaaaaagaggagtggcgaacgggtgagtaacacgtgggtaacctgcccatcagaaggggataacacttggaaacaggtgctaataccgtataataattaaaaccgcatggttttaatttgaaaggcgctttacggtgccactgatggatggacccgcggtgcattagctagttggtgaggtaacggctcaccaaggcgacgatgcatagccgacctgagagggtgatcggccacattgggactgagacacggcccaaactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcaaacaggattagataccctggtagtccacgccgtaaacgatgagtgctaagtgttggagggtttccgcccttcagtgctgcagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatgggaagtacaacgagtcgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3670 - DNA, 1565 bp, Enterococcus wangshanyuanii
  ref <308>: DATABASE ACCESSION NUMBER: NCBI ACCESSION: NZ_CP021874.1
  ref <309>: DATABASE ENTRY DATE: 2019-04-01
  ref <313>: RELEVANT RESIDUES IN SEQ ID NO: (1)..(1565)
tatgagagtttgatcctggctcaggacgaacgctggcggcgtgcctaatacatgcaagtcgaacgcttcttttctaccgagtgcttgcactcatttgaaaagaggagtggcggacgggtgagtaacacgtgggtaacctgcccatcagaaggggataacacttggaaacaggtgctaataccgtataacagtcgacaccgcatggtgttgatttgaaagacgctttcgggtgtcactgatggatggacccgcggtgcattagctagttggtgaggtaacggctcaccaaggcgatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtaggagagtaactgctcttaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatgggaagtacaacgagtcgctaggccgcgaggtcatgcaaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgaaagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 3671 - DNA, 1557 bp, Enterovibrio sp. A649
  ref <308>: DATABASE ACCESSION NUMBER: NCBI ACCESSION: NZ_SCHN01000027.1
  ref <309>: DATABASE ENTRY DATE: 2019-04-01
  ref <313>: RELEVANT RESIDUES IN SEQ ID NO: (1)..(1557)
taattgaagagtttgatcatggctcagattgaacgctggcggcaggcctaacacatgcaagtcgagcggcagcgacaacattgacccttcgggtgatttgttgggcggcgagcggcggacgggtgagtaatggctgggaacctgccctgacgtgggggataacagttggaaacgactgctaataccgcatgatgtctacggaccaaagaggaggaccttcgggcttctcgcgtcgggatgggcccagttgggattagctagttggtgaggtaatggctcaccaaggcgacgatccctagctggtttgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagcagtgaggaaggcgtgatggttaatacccattacgtttgacgttagctgcagaagaagcaccggctaactccgtgccagcagccgcggtaatacggagggtgcgagcgttaatcggaattactgggcgtaaagcgcatgcaggcggtttgttaagcaagatgtgaaagccccgggctcaacctgggaaccgcattttgaactggcaggctagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgctgtaaacgatgtctacttggaggttgcggtcttgaactgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccacagaagccggaagagattctggtgtgccttcgggaactgtgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcatatacagagggcagcgaggcagcgatgtggagcgaatcccagaaagtatgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttaacga

SEQ ID NO: 3672 - DNA, 1419 bp, Enterovibrio sp. CAIM 600
  ref <308>: DATABASE ACCESSION NUMBER: NCBI ACCESSION: NZ_PEIB01000025.1
  ref <309>: DATABASE ENTRY DATE: 2019-04-01
  ref <313>: RELEVANT RESIDUES IN SEQ ID NO: (1)..(1419)
gtacctgcctgatgtgggggataacagttggaaacgactgctaataccgcataacgtctacggaccaaagagggggatcttcggacctctcgcgtcaggatgggcccagttgggattagctagttggtgaggtaatggctcaccaaggcgacgatccctagctggtttgagaggatgatcagccacactggaactgagacacggtccagactcctacgggaggcagcagtggggaatattgcacaatgggggaaaccctgatgcagccatgccgcgtgtgtgaagaaggccttcgggttgtaaagcactttcagctgtgaggaagggtgaatcgttaatagcggttcatcttgacgttagcagcagaagaagcaccggctaactccgtgccagcagccgcggtaatacggagggtgcgagcgttaatcggaattactgggcgtaaagcgcatgcaggcggtctgttaagcaagatgtgaaagccccgggctcaacctgggaaagtcattttgaactggcaggctagagtcttgtagaggggggtagaatttcaggtgtagcggtgaaatgcgtagagatctgaaggaataccggtggcgaaggcggccccctggacaaagactgacgctcagatgcgaaagcgtggggagcaaacaggattagataccctggtagtccacgccgtaaacgatgtctacttggaggctgttgtctagaacagtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaattttccagagatggattagtgccttcgggagctctgagacaggtgctgcatggctgtcgtcagctcgtgttgtgaaatgttgggttaagtcccgcaacgagcgcaacccttatccttgtttgccagcacataatggtgggaactccagggagactgccggtgataaaccggaggaaggtggggacgacgtcaagtcatcatggcccttacgagtagggctacacacgtgctacaatggcatatacagagggcagcgagaccgcgaggtggagcgaatcccagaaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaccagaagtagatagcttaaccttcgggagggcgtttaccacggtgtggttcatgactggggtgaagtcgtaacaaggtagccctaggggaacctggggctggatcacctccttaacga

SEQ ID NO: 3673 - DNA, 1467 bp, Epibacterium mobile
  ref <308>: DATABASE ACCESSION NUMBER: NCBI ACCESSION: NZ_LR027553.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgagatcttcggatctagcggcggacgggttagtaacgcgtgggaacgtacccaaaggtagggaatagccactggaaacggtgagtaataccctatgtgcccttcgggggaaagatttatcgcctttggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggggcaaccctgatccagccatgccgcgtgagtgatgaaggccctagggtcgtaaagctctttcgcctgtgaagataatgactgtagcaggtaaagaaaccccggctaactccgtgccagcagccgcggtaatacggagggggttagcgttgttcggaattactgggcgtaaagcgcgcgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatttggctttcacttcggtgaccgagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 3674 - DNA, 1463 bp, Epibacterium multivorans
  ref <308>: DATABASE ACCESSION NUMBER: NCBI ACCESSION: NZ_FOMC01000040.1
  ref <309>: DATABASE ENTRY DATE: 2019-04-01
  ref <313>: RELEVANT RESIDUES IN SEQ ID NO: (1)..(1463)
tcaacttgagagtttgatcctggctcagaacgaacgctggcggcaggcctaacacatgcaagtcgagcgcaccttcgggtgagcggcggacgggttagtaacgcgtgggaacgtgcccagatctgcggaatagccactggaaacggtgagtaataccgcatacgcccttcgggggaaagatttatcggatttggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccctagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcagcaagcatgcttgttggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatttgtcgccacctccagagatggagttttcccttcggggacggcaggacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgggttaatccccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgctaacttttgaggcagcggaccacggtgagctcagcgactggggtgaagtcgtaacaaggtagccgtaggggaacctgcggctggatcacctcctttctaa

SEQ ID NO: 3675 - DNA, 1469 bp, Epibacterium scottomollicae
  ref <308>: DATABASE ACCESSION NUMBER: NCBI ACCESSION: NZ_PVUF01000045.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgctctcttcggagggagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgaagataatgactgtagcaggtaaagaaaccccggctaactccgtgccagcagccgcggtaatacggagggggttagcgttgttcggaattactgggcgtaaagcgcgcgtaggcggactggaaagttgggggtgaaatcccagggctcaaccctggaactgcctccaaaactatcagtctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatttggctttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 3676 - DNA, 1529 bp, Epulopiscium sp. N.t. morphotype B
  ref <308>: DATABASE ACCESSION NUMBER: NCBI ACCESSION: NZ_ABEQ01000069.3
  ref <309>: DATABASE ENTRY DATE: 2019-04-01
  ref <313>: RELEVANT RESIDUES IN SEQ ID NO: (1)..(1529)
tttaaccgagagtttgatcctggctcaggatgaacgctggcggcgtgcttaacacatgcaagtcgaacggacttgggagcttgctcttaagttagtggcggacgggtgagtaacacgtgggtaacctgccctatagaatggaataacgtttggaaacagacgctaataccatataacctaattaggtcgcatgacttggttagcaaagattttatcgctataggatggacctgcgttggattagctagttggtgagataaaagctcaccaaggcgacgatccatagccggcctgagagggtgaacggccacactgggactgagacacggcccagactcctacgggaggcagcagtggggaatattgcacaatgggcgcaagcctgatgcagcgacgccgcgtgaaggatgaaggttttcggatcgtaaacttctatcagcagggaagaaaaaaatgacggtacctgactaagaagccccggctaactacgtgccagcagccgcggtaatacgtagggggcgagcgttatccggaattactgggtgtaaagggtgtgtaggcggcatggtaagtcagatgtgaaaacttggggctcaacttcaagattgcatctgaaactgctaagctagagtgcaggagaggaaagtggaattccaagtgtagcggtgaaatgcgtagagatttggaggaacaccagtagcgaaggcgactttctggactgtaactgacgctgagacacgaaagcgtggggagcgaacaggattagataccctggtagtccacgccgtaaacgatgaatactaggtgtcgggccttacggggttcggtgccgcagctaacgcattaagtattccacctgggaagtacgaccgcaaggttgaaactcaaaggaattgacggggacccgcacaagcggtggagcatgtggtttaattcgaagcaacgcgaagaaccttacctaaacttgacatccttatgaccggagggtaatgcctctttctctagcttgctagggcataagtgacaggtggtgcatggttgtcgtcagctcgtgtcgtgagatgttgggttaagtcccgcaacgagcgcaacccttatcttcagtagccatcatttagttgggcactctggagagactgccaaggacaacttggaggaaggtggggatgacgtcaaatcatcatgccccttatgtttagggctacacacgtgctacaatggctgctacaaagggaagcatagcggtaacgtgaagcaaaccccaaaaaagcagtcccagttcggattgtggtctgcaactcgaccacatgaagttggaatcgctagtaatcgcgaatcagaatgtcgcggtgaatacgttcccgggtcttgtacacaccgcccgtcacaccatggaagttgagggggcccaacgtcagtgacctaaccgcaaggagggagctgcctaaggcaaaatcaatgactggggtgaagtcgtaacaaggtagccgtatcggaaggtgcggctggatcacctcctttctaaggaa

SEQ ID NO: 3677 - DNA, 1562 bp, Ereboglobus luteus
  ref <308>: DATABASE ACCESSION NUMBER: NCBI ACCESSION: NZ_CP023004.1
  ref <309>: DATABASE ENTRY DATE: 2019-04-01
  ref <313>: RELEVANT RESIDUES IN SEQ ID NO: (1)..(1562)
ttttcggagagtttgatcctggctcagaatgaacgctggcggcgtggttaagacatgcaagtcggacgggacttgcggtgtagcaatacattgcaagttcagtggcgaacgggtgcgtaacacgtaaacaatctaccttgaagtggggaatagctcgtcgaaaggcgaattaataccgcatgtggtaggctctcgcatgagagcttcactaaaggcagggaccgcaaggcctgccgcttcaagaggagtttgcggcctatcagcttgttggcgaggtaacggctcaccaaggctaagacgggtagctggtctgagaggacgatcagccacactggaactgagacacggtccagacacctacgggtggcagcagtttcgaatcattcacaatgggcgaaagcctgatggtgcgacgccgcgtgagggacgaaggtcttcggattgtaaacctctgtcaccggggaagaaacgctaagagttaatagcccttagcctgacttaacccggagaggaagcagtggctaactctgtgccagcagccgcggtaatacagagactgcaagcgttattcggattcactgggcgtaaagggtgcgcaggcggccatgtgtgtctggtgtgaaatctcggggcttaactccgaaattgcgccggaaactacatggctagagtactggagagggtagcggaattcatggtgtagcagtgaaatgcgtagatatcatgaggaacaccaatggcgaaggcagctacctggacagttactgacgctcaggcacgaaagcgtggggagcgaaagggattagatacccctgtagtccacgccctaaacggtgcacactaggtcttggaggattcgaccccttcagggcccaagctaacgcgttaagtgtgccgcctgaggactacggccgcaaggctaaaactcaaaggaattgacgggggcccgcacaagcggtggagtatgtggcttaattcgatgcaacgcgaagaaccttacctggccttgacatgctttggaccggcgctgaaaggcgccttctcttcggagccggagcacaggtgctgcatggctgtcgtcagctcgtgtcgtgagatgttgcgttaagtcgcgcaacgagcgcaacccctgtccttagttgccatcatttagttgggcactctaaggagacaaaccctctctgagggtgggaaggtggggatgacgtcaagtcaggatggcccttacggccagggctgcacacgtactacaatgctcggtacagagggacgctacgccgcgaggcgatgcaaatctcaaaaaccgagcccagttcagattgtagtctgcaactcgactacatgaagttggaatcgctagtaatggcgcatcagctacggcgccgtgaatacgttcccgggccttgtacacaccgcccgtcacatcatgaaagccggtttcgcccgaagtgcgtttgccaaccagcaatggaggcggcgccctaaggtgaagctggtgattgggatgaagtcgtaacaaggtaaccgtaggggaacctgcggttggatcacctcctttctaa

SEQ ID NO: 3678 - DNA, 1440 bp, Eremococcus coleocola
  ref <308>: DATABASE ACCESSION NUMBER: NCBI ACCESSION: NZ_AUAT01000051.1
  ref <309>: DATABASE ENTRY DATE: 2019-04-01
  ref <313>: RELEVANT RESIDUES IN SEQ ID NO: (1)..(1440)
gagtaacacgtgggaaacctacccttgagcgggggataacggtcggaaacgatcgctaataccgcataacagcaatcatcgcctgatggttgattgaaagatggctctgctatcactcaaggatgggcccgcggtgcattagctagttggtaaggtaacggcttaccaaggccatgatgcatagccgacctgagagggtaatcggccacattgggactgagacacggcccaaactcctacgggaggcagcagtagggaatcttccgcaatggacgcaagtctgacggagcaacgccgcgtgtgtgaagaaggttttcggatcgtaaagcactgttattagccaagaacacccctagtagtaactggctagggattgacggtaactaatcagaaagccacggctaactacgtgccagcagccgcggtaatacgtaggtggcaagcgttgtccggatttattgggcgtaaagggagcgcaggcggtgacttaagtctgatgtgaaagcccacggcttaaccgtggagggtcattggaaactgggtcacttgagtacagaagaggaaagcggaattccatgtgtagcggtgaaatgcgtagatatatggaggaacaccagtggcgaaggcggctttctggtctgatactgacgctgaggctcgaaagcgtggggagcaaacaggattagataccctggtagtccacgccgtaaacgatgagtgctaagtgttggagggtttccacccttcagtgctggcgttaacgcaataagcactccgcctggggagtacggtcgcaagactgaaactcaaaggaattgacggggacccgcacaagcggtggagcatgtggtttaattcgaagcaacgcgaagaaccttaccaggtcttgacatcctatgaccactctagagatagagtttctcttcggagcatagagacaggtggtgcatggttgtcgtcagctcgtgtcgtgagatgttgggttaagtcccgcaacgagcgcaacccttataactagttgccagcattcagatggggactctagttagactgccggtgacaaaccggaggaaggtggggatgacgtcaaatcatcatgccccttatgacctgggctacacacgtgctacaatggacgatacaacgagcagcaaactcgcgagggtaagcgaatctcttaaagtcgttctcagttcggattgcaggctgcaactcgcctgcatgaagccggaatcgctagtaatcgtggatcagcacgccacggtgaatccgttcccgggtcttgtacacaccgcccgtcacaccacgagagtttgtaacacccgaagccggtggcctaacctatgagggagccgtcgaaggtgggatagatgattggggtgaagtcgtaacaaggtagccgtatcggaaggtgcggctggatcacctcctttctaagga

SEQ ID NO: 3679 - DNA, 1284 bp, Erwinia amylovora
  ref <308>: DATABASE ACCESSION NUMBER: NCBI ACCESSION: NZ_RQKG01000029.1
  ref <309>: DATABASE ENTRY DATE: 2019-04-01
  ref <313>: RELEVANT RESIDUES IN SEQ ID NO: (1)..(1284)
ggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggtgagaggttaataacctcctgcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattctgcagagatgcggaagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3680 - DNA, 1548 bp, Erwinia billingiae
  ref <308>: DATABASE ACCESSION NUMBER: NCBI ACCESSION: NZ_PCQJ01000025.1
  ref <309>: DATABASE ENTRY DATE: 2019-04-01
  ref <313>: RELEVANT RESIDUES IN SEQ ID NO: (1)..(1548)
ttaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcttcggaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcagatgtgaaatccccgggcttaacctgggaactgcatttgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgagtaatgtcgggaactcaaaggagactgccggtgacaaaccggaggaaggtggggatgacgtcaagtcatcatggcccttacggccagggctacacacgtgctacaatggcgcatacaaagagaagcgaactcgcgagagcaagcggacctcacaaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3681 - DNA, 1548 bp, Erwinia persicina
  ref <308>: DATABASE ACCESSION NUMBER: NCBI ACCESSION: NZ_CP022725.1
  ref <309>: DATABASE ENTRY DATE: 2019-04-01
  ref <313>: RELEVANT RESIDUES IN SEQ ID NO: (1)..(1548)
ttaattgaagagtttgatcatggctcagattgaacgctggcggcaggcctaacacatgcaagtcgaacggtagcacagagagcttgctctcgggtgacgagtggcggacgggtgagtaatgtctgggaaactgcctgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaataacttcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3682 - DNA, 1549 bp, Erwinia pyrifoliae
  ref <308>: DATABASE ACCESSION NUMBER: NCBI ACCESSION: NZ_CP023567.1
  ref <309>: DATABASE ENTRY DATE: 2019-04-01
  ref <313>: RELEVANT RESIDUES IN SEQ ID NO: (1)..(1549)
ttaattgaagagtttgatcatggctcagattgaacgctggcggcaggcctaacacatgcaagtcgaacggtagcgggaagaagcttgcttctttgccgacgagtggcggacgggtgagtaatgtctgggaaactgcccgatggagggggataactactggaaacggtagctaataccgcataacgtctacggaccaaagtgggggaccttcgggcctcacaccatcggatgtgcccagatgggattagcttgtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatggggttaataacctcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattttgcagagatgcggaagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3683 - DNA, 1549 bp, Erwinia sp. 198
  ref <308>: DATABASE ACCESSION NUMBER: NCBI ACCESSION: NZ_RHUM01000024.1
  ref <309>: DATABASE ENTRY DATE: 2019-04-01
  ref <313>: RELEVANT RESIDUES IN SEQ ID NO: (1)..(1549)
ttaattgaagagtttgatcatggctcagattgaacgctggcggcaggcctaacacatgcaagtcgaacggtagcacagagaagcttgcttcttgggtgacgagtggcggacgggtgagtaacgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgtgtcgattgacgttacccgcagaagaagcaccggctaactccgtgccagcagccgcggtaatacggagggtgcaagcgttaatcggaattactgggcgtaaagcgcacgcaggcggtctgtcaagtcagatgtgaaatccccgggcttaacctgggaactgcatttgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccctgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgaactcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3684 - DNA, 1548 bp, Erwinia sp. AG740
  ref <308>: DATABASE ACCESSION NUMBER: NCBI ACCESSION: NZ_QJJH01000024.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcgggcggtagcacaggggagcttgctccctgggtgacgagcggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaaaggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaagggagcaggcttaatacgtctgttcattgacgttacccgcagaagaagcaccggctaactccgtgccagcagccgcggtaatacggagggtgcaagcgttaatcggaatgactgggcgtaaagcgcacgcaggcggtctgttaagttggatgtgaaatccccgggcttaacctgggaactgcattcaaaactgacaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccagagaagcctgcagagatgcgggtgtgccttcgggagctctgagacaggtgctgcatggctgtcgtcagctcgtgttgtgaaatgttgggttaagtcccgcaacgagcgcaacccttatcctttgttgccagcacgtaatggtgggaactcaagggagactgccggtgataaaccggaggaaggtggggatgacgtcaagtcatcatggcccttacgagtagggctacacacgtgctacaatggcgtatacaaagagaagcgacctcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccgag

SEQ ID NO: 3685 - DNA, 1547 bp, Erwinia sp. JUb26
  ref <308>: DATABASE ACCESSION NUMBER: NCBI ACCESSION: NZ_RJVB01000022.1
  ref <309>: DATABASE ENTRY DATE: 2019-04-01
  ref <313>: RELEVANT RESIDUES IN SEQ ID NO: (1)..(1547)
ttaattgaagagtttgatcatggctcagattgaacgctggcggcaggcctaacacatgcaagtcgaacggtagcacagagagcttgctcttgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgaggttaataaccttatcgattgacgttacccgcagaagaagcaccggctaactccgtgccagcagccgcggtaatacggagggtgcaagcgttaatcggaattactgggcgtaaagcgcacgcaggcggtctgtcaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3686 - DNA, 1548 bp, Erwinia sp. OLMDLW33
  ref <308>: DATABASE ACCESSION NUMBER: NCBI ACCESSION: NZ_MTCH01000254.1
  ref <309>: DATABASE ENTRY DATE: 2019-04-01
  ref <313>: RELEVANT RESIDUES IN SEQ ID NO: (1)..(1548)
ttaattgaagagtttgatcatggctcagattgaacgctggcggcaggcctaacacatgcaagtcgaacggtagcacagagagcttgctcttgggtgacgagtggcggacgggtgagtaatgtctgggaaactgcccgatggagggggataactactggaaacggtagctaataccgcataacgtcttcggaccaaagtgggggaccttcgggcctcacaccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagtggggaggaaggcgatgaagttaatagcttcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 3687 - DNA, 1547 bp, Erwinia toletana
  ref <308>: DATABASE ACCESSION NUMBER: NCBI ACCESSION: NZ_KB372810.1
  ref <309>: DATABASE ENTRY DATE: 2019-04-01
  ref <313>: RELEVANT RESIDUES IN SEQ ID NO: (1)..(1547)
ttaattgaagagtttgatcatggctcagattgaacgctggcggcaggcctaacacatgcaagtcgggcggtagcacagaggagcttgctccttgggtgacgagcggcggacgggtgagtaatgtctggggatctgcccgatggagggggataactactggaaacggtagctaataccgcataatctcgcaagagcaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacctgggaactgcatttgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgcgtgatggcgggaactcaaaggagactgccggtgataaaccggaggaaggtggggatgacgtcaagtcatcatggcccttacggccagggctacacacgtgctacaatggcgcatacaaagagaagcgaactcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaacctccgggagggcgcttaccactttgtgattcatgactggggtgaagtcgtaacaaggtaaccgtaggggaacctgcggttggatcacctccttacct

SEQ ID NO: 3688 - DNA, 1527 bp, Erysipelatoclostridium ramosum; identical to SEQ ID NO: 2933
  ref <308>: DATABASE ACCESSION NUMBER: NCBI ACCESSION: NZ_QSLK01000025.1
  ref <309>: DATABASE ENTRY DATE: 2019-04-01
  ref <313>: RELEVANT RESIDUES IN SEQ ID NO: (1)..(1527)

SEQ ID NO: 3689 - DNA, 2543 bp, Erysipelothrix rhusiopathiae
  ref <308>: DATABASE ACCESSION NUMBER: NCBI ACCESSION: NZ_LR134439.1
  ref <309>: DATABASE ENTRY DATE: 2019-04-01
  ref <313>: RELEVANT RESIDUES IN SEQ ID NO: (1)..(2543)
caaatggagagtttgatcctggctcaggatgaacgctggcggcgtgcctaatacatgcaagtcgaacgaagtgaagaggagcttgctccttggaacttagtggcgaacgggtgagtaatacataagcaacctgcctcgatgcctgggataacagagggaaacttctgctaataccggatacgttaatctaaacatcttagattaattaaagatggatacatcacacgagatggcttatggcgcattagttagttggtaaggtaacggcttaccaagacgatgatgcgtagccgacctgagagggtgaccggccacactgggactgagacacggcccagactcctacgggaggcagcagtagggaattttcggcaatggggaaaccctgaccgagcaacgccgcgtgagtgaagacggccttcggttgtaaagctctgttgtaagggaagaacgataggaagagggaatgcttcttatatgacggtaccttaccagaaagccacggctaactacgtgccagcagccgcggtaatacgtaggtggcaagcgttatccggaattattgggcgtaagggagcgcaggcggtttatcaagtttatggttaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggagaaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaagcacagagatgtgtaatagttatggcggatacaggtggtgcatggttgtcgtcagctcgtgtcgtgagatgttgggttaagtccgcaacgagcgcaacccttgtctttagttaccagcattaagttggggactctaaaggactgccggtgataaaccggaggaaggtggggatgacgtcaaatcatcatgccccttatgatctggctacacacgtactacaatggcgtatacagagggcagcgaagcagcgatgcggagcgaatctcagaaagtacgtctcagttcggattggagtctgcaactcgactccatgaagtcggaatcgctagtaatcgcggatcagaatgccgcggtgaatacgtttcgggccttgtacacaccgcccgtcaaaccatgagagttggtaataccgaagccggtggcctaacctagtttactaggagggaccgtcgaaggtaggatcgatgattggggttaagtcgtaacaaggtatccctaccggaaggtaaagccacggctaactacgtgccagcagccgcggtaatacgtaggtggcaagcgttatccggaattattgggcgtaaagggagcgcaggcgtttatcaagtttatggttaaagttcggggcttaaccccgtgatgccatagaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggagaaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcacagagatgtgtaatagttatggcggatacaggtggtgcatggttgtcgtcagctcgtgtcgtgagatgttgggttaagtcccgcaacgagcgcaacccttgtctttagttaccagcattaagttggggactctaaagagactgccggtgataaaccggaggaaggtggggatgacgtcaaatcatcatgccccttatgatctgggctacacacgtactacaatggcgtatacagagggcagcgaagcagcgatgcggagcgaatctcagaaagtacgtctcagttcggattggagtctgcaactcgactccatgaagtcggaatcgctagtaatcgcggatcagaatgccgcggtgaatacgttctcgggccttgtacacaccgcccgtcaaaccatgagagttggtaatacccgaagccggtggcctaacctagtttactaggagggagccgtcgaaggtaggatcgatgattggggttaagtcgtaacaaggtatccctaccggaaggtggggatggatcacctcctttct

SEQ ID NO: 3690 - DNA, 1537 bp, Erysipelothrix sp. 15TAL0474
  ref <308>: DATABASE ACCESSION NUMBER: NCBI ACCESSION: NZ_CP034234.1
  ref <309>: DATABASE ENTRY DATE: 2019-04-01
  ref <313>: RELEVANT RESIDUES IN SEQ ID NO: (1)..(1537)
caaatggagagtttgatcctggctcaggatgaacgctggcggcgtgcctaatacatgcaagtcgaacgaagtgaagaggagcttgctccttggaacttagtggcgaacgggtgagtaatacataagcaacctgcctcgatgcctgggataacagagggaaacttctgctaataccggatacgttaatctaagacatcttagattaattaaagatgggatacatcacaacgagatgggcttatggcgcattagttagttggtaaggtaacggcttaccaagacgatgatgcgtagccgacctgagagggtgaccggccacactgggactgagacacggcccagactcctacgggaggcagcagtagggaattttcggcaatgggggaaaccctgaccgagcaacgccgcgtgagtgaagacggccttcgggttgtaaagctctgttgtaagggaagaacgataggaagagggaatgctttttatatgacggtaccttaccagaaagccacggctaactacgtgccagcagccgcggtaatacgtaggtggcaagcgttatccggaattattgggcgtaaagggagcgcaggcggtttatcaagtttatggttaaagttcggggcttaaccccgtgatgccatagaaactggtagactagagtgcaggagaggttagtggaattccatgtgtagcggtaaaatgcgtagatatatggaggaacaccagtggcgaaggcggctaactggcctgtaactgacgctgaggctcgaaagcgtggggagcaaataggattagataccctagtagtccacgccgtaaacgatggatactaagtgttggagaaattcagtgctgtagttaacgcaataagtatcccgcctggggagtatgcgcgcaagcgtaaaactcaaaggaattgacgggggcccgcacaagcggtggagtatgtggtttaattcgaagcaacgcgaagaaccttaccaggtcttgacataccgcgcaaaagcacagagatgtgtaatagttatggcggatacaggtggtgcatggttgtcgtcagctcgtgtcgtgagatgttgggttaagtcccgcaacgagcgcaacccttgtctttagttaccagcattaagttggggactctaaagagactgccggtgataaaccggaggaaggtggggatgacgtcaaatcatcatgccccttatgatctgggctacacacgtactacaatggcgtatacagagggcagcgaagcagcgatgcggagcgaatctcagaaagtacgtctcagttcggattggagtctgcaactcgactccatgaagtcggaatcgctagtaatcgcggatcagaatgccgcggtgaatacgttctcgggccttgtacacaccgcccgtcaaaccatgagagttggtaatacccgaagccggtggctaacctagtttactaggaggagccgtcgaaggtaggatcgatgattggggttaagtcgtaacaaggtatccctaccggaaggtggggatggacctcctttcta

SEQ ID NO: 3691 - DNA, 1547 bp, Erysipelotrichaceae bacterium AF15-26LB
  ref <308>: DATABASE ACCESSION NUMBER: NCBI ACCESSION: NZ_QVGW01000004.1
  ref <309>: DATABASE ENTRY DATE: 2019-04-01
  ref <313>: RELEVANT RESIDUES IN SEQ ID NO: (1)..(1547)
caaatggagagtttgatcctggctcaggatgaacgctggcggcatgcctaatacatgcaagtcgaacgaagtctctagggagcttgcttccaaagagacttagtggcgaacgggtgagtaacacgtaggtaacctgcccatgtgtctgggataactgctggaaacggtagctaaaaccggataggtatacggagcgcatgctctgtatattaaagcacccttcaaggtgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtaggctagagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataaatatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaaggagcgaatctcataaaggccgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctcctttctaagga

SEQ ID NO: 3692 - DNA, 1326 bp, Erysipelotrichaceae bacterium AF19-24AC
  ref <308>: DATABASE ACCESSION NUMBER: NCBI ACCESSION: NZ_QVGT01000005.1
  ref <309>: DATABASE ENTRY DATE: 2019-04-01
  ref <313>: RELEVANT RESIDUES IN SEQ ID NO: (1)..(1326)
cccctcaaggtgtgaacatggatggacctgcggcgcattagctagttggtgaggtaacggcccaccaaggcgatgatgcgtagccggcctgagagggtaaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggctcatagaggaaatgctatgggagtgacggtagcttaccagaaagccacggctaactacgtgccagcagccgcggtaatacgtaggtggcaagcgttatccggaatcattgggcgtaaagggtgcgtaggtggcgtactaagtctgtagtaaaaggcaatggctcaaccattgtaagctatggaaactggtaggctagagtgcagaagagggcgatggaattccatgtgtagcggtaaaatgcgtagatatatggaggaacaccagtggcgaaggcggtcgcctggtctgtaactgacactgaggcacgaaagcgtggggagcaaataggattagataccctagtagtccacgccgtaaacgatgagaactaagtgttggaggaattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggaaacaaataccctagagatagggggataaatatggatcacacaggtggtgcatggttgtcgtcagctcgtgtcgtgagatgttgggttaagtcccgcaacgagcgcaacccttgtcgcatgttaccagcatcaagttggggactcatgcgagactgccggtgacaaaccggaggaaggtggggatgacgtcaaatcatcatgccccttatggcctgggctacacacgtactacaatggcgaccacaaagagcagcgacttggtgacaaggagcgaatctcataaaggccgtctcagttcggattgaagtctgcaactcgacttcatgaagtcggaatcgctagtaatcgcagatcagcatgctgcggtgaatacgttctcgggccttgtacacaccgcccgtcaaaccatgggagtcagtaatacccgaagccggtggcataaccgtaaggagtgagccgtcgaaggtaggaccgatgactggggttaagtcgtaacaaggtatccctacgggaacgtggggatggatcacctcctttcta

SEQ ID NO: 3693 - DNA, 1541 bp, Erysipelotrichaceae bacterium AM07-12
  ref <308>: DATABASE ACCESSION NUMBER: NCBI ACCESSION: NZ_QVGN01000001.1
  ref <309>: DATABASE ENTRY DATE: 2019-04-01
  ref <313>: RELEVANT RESIDUES IN SEQ ID NO: (1)..(1541)
caaatggagagtttgatcctggctcaggatgaacgctggcggcatgcctaatacatgcaagtcgaacgaagtctttaggaagcttgcttccaaagagacttagtggcgaacgggtgagtaacacgtaggtaacctgcccatgtgcccgggataactgctggaaacggtagctaaaaccggataggtatgagggaggcatcttcctcatattaaagcaccttcgggtgtgaacatggatggacctgcggcgcattagctggttggtgaggtaacggcccaccaaggcgatgatgcgtagccgacctgagagggtgaacggccacattgggactgagacacggcccaaactcctacgggaggcagcagtagggaattttcgtcaatggggggaaccctgaacgagcaatgccgcgtgtgtaaagaaggtcttcggatcgtaaagcactgttgtaagtgaagaatgccacatagaggaaatgctatgtgggtgacggtagcttaccagaaagccacggctaactacgtgccagcagccgcggtaatacgtaggtggcaagcgttatccggaatcattgggcgtaaagggtgcgtaggtggcacgataagtctgaagtaaaaggcaacagctcaactgttgtatgctttggaaactgtcgagctagagtgcagaagagggcgatggaattccatgtgtagcggtaaaatgcgtagatatatggaggaacaccagtggcgaaggcggtcgcctggtctgtaactgacactgatgcacgaaagcgtggggagcaaataggattagataccctagtagtccacgccgtaaacgatgagaactaagtgttggagagattcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatataaatgttctagagatagaaagatagctatatatcacacaggtggtgcatggttgtcgtcagctcgtgtcgtgagatgttgggttaagtcccgcaacgagcgcaacccttgtcttctgttaccagcattaagttggggactcaggagagactgccggtgacaaaccggaggaaggtggggatgacgtcaaatcatcatgccccttatggcctgggctacacacgtactacaatggcgcctacaaagagcagcgacaccgcgaggtggagcgaatctcataaagggcgtctcagttcggattgaagtctgcaactcgacttcatgaagtcggaatcgctagtaatcgcagatcagcatgctgcggtgaatacgttctcgggccttgtacacaccgcccgtcaaaccatgggagttggtaatacccgaagccggtggcataaccgcaaggagtgagccgtcgaaggtaggaccgatgactggggttaagtcgtaacaaggtatccctacgggaacgtggggatggatcacctcctttcta

SEQ ID NO: 3694 - DNA, 1541 bp, Erysipelotrichaceae bacterium AM07-35-1; identical to SEQ ID NO: 3693
  ref <308>: DATABASE ACCESSION NUMBER: NCBI ACCESSION: NZ_QVGM01000001.1
  ref <309>: DATABASE ENTRY DATE: 2019-04-01
  ref <313>: RELEVANT RESIDUES IN SEQ ID NO: (1)..(1541)

SEQ ID NO: 3695 - DNA, 1550 bp, Erysipelotrichaceae bacterium AM17-60
  ref <308>: DATABASE ACCESSION NUMBER: NCBI ACCESSION: NZ_QUCU01000005.1
  ref <309>: DATABASE ENTRY DATE: 2019-04-01
  ref <313>: RELEVANT RESIDUES IN SEQ ID NO: (1)..(1550)
caaatggagagtttgatcctggctcaggatgaacgctggcggcatgcctaatacatgcaagtcgaacggagcgaatatggaagcttgcttccgtaagagctcagtggcgaacgggtgagtaacacgtaggtaacctgcccatgtgcccgggataactgctggaaacggtagctaaaaccggataggtgaataggaggcatctcttattcattaaaggacctgcaaaggtgcgaacatggatggacctgcggcgcattagctggttggagtggtaacggcacaccaaggcgacgatgcgtagccgacctgagagggcgaacggccacattgggactgagacacggcccaaactcctacgggaggcagcagtagggaattttcgtcaatggggggaaccctgaacgagcaatgccgcgtgagtgaagaaggtcttcggatcgtaaagctctgttgtaagtgaagaacggtcagtagaggaaatgatactgaagtgacggtagcttaccagaaagccacggctaactacgtgccagcagccgcggtaatacgtaggtggcgagcgttatccggaatcattgggcgtaaagggtgcgcaggtggtacattaagtccgaagtaaaaggcagcagctcaactgctgttggctttggaaactggtgaactggagtgcaggagagggcgatggaattccatgtgtagcggtaaaatgcgtagatatatggaggaacaccagtggcgaaggcggtcgcctggcctgcaactgacactgaggcacgaaagcgtggggagcaaataggattagataccctagtagtccacgccgtaaacgatgagaactaagtgttggggagactcagtgctgcagttaacgcaataagttctccgcctggggagtatgcacgcaagtgtgaaactcaaaggaattgacgggggcccgcacaagcggtggagtatgtggtttaattcgaagcaacgcgaagaaccttaccaggccttgacatggatgtaaatgccctagagatagggagatagctatacatcacacaggtggtgcatggttgtcgtcagctcgtgtcgtgagatgttgggttaagtcccgcaacgagcgcaacccttgtcgcatgttaccagtattgagttagggactcatgcgagactgccggtgacaaaccggaggaaggtggggatgacgtcaaatcatcatgccccttatggcctgggctacacacgtactacaatggcggctacaaagagaagcgaacctgcgagggggagcggaactcataaaggccgtctcagttcggattggagtctgcaactcgactccatgaagtcggaatcgctagtaatcgcagatcagcatgctgcggtgaatacgttctcgggccttgtacacaccgcccgtcaaaccatgggagttggtaatacccgaagccggtggcataaccgtgaggagtgagccgtcgaaggtaggaccgatgactggggttaagtcgtaacaaggtatccctacgggaacgtggggatggatcacctcctttctaaggaga

SEQ ID NO: 3696 - DNA, 1527 bp, Erysipelotrichaceae bacterium OH741 COT-311
  ref <308>: DATABASE ACCESSION NUMBER: NCBI ACCESSION: NZ_RQZE01000016.1
  ref <309>: DATABASE ENTRY DATE: 2019-04-01
  ref <313>: RELEVANT RESIDUES IN SEQ ID NO: (1)..(1527)
caaacggagagtttgatcctggctcaggatgaacgctggcggcgtgcctaatacatgcaagttgaacggacttggagggtgcttgcacctaacaagttagtagcgaacgggtgagtaatacataagcaacctacctattagactgggataactatgggaaacgatagctaataccggataggtaacttgaaggcatctttaagttattaaaggttagagacactaatagatgggcttatggcgtattagttagttggtgaggtaacggctcaccaagacgatgatacgtagccggcctgagagggtgaacggccacattgggactgagacacggcccagactcctacgggaggcagcagtagggaattttcggcaatgggcgcaagcctgaccgagcaacgccgcgtgagtgaagaaggccttcgggttgtaaagctctgttataaattaagaatggctataagggacttatagagatgactgatttaccagaaagccacggctaactacgtgccagcagccgcggtaatacgtaggtggcaagcgttatccggaattattgggcgtaaagggtgcgcaggcggtttgttaagtttaaggtgaaagcgtggggctcaaccccatacagccttagaaactggcagactagagtacagaagagggtagtggaatttcatgtgtagcggtaaaatgcgtagatatatgaaggaacaccagtggcgaaggcggctacctggtctgtaactgacgctcatgcacgaaagcgtggggagcaaataggattagataccctagtagtccacgccgtaaacgatgaatactaagtgttggggaaactcagtgctgcagttaacgcaataagtattccgcctggggagtatgcacgcaagtgtgaaactcaaaggaattgacgggggcccgcacaagcggtggagtatgtggtttaattcgacgcaacgcgaagaaccttaccaggtcttgacatcccttgcaagtctatagagatatagaggaggatatcaaggtgacaggtggtgcatggttgtcgtcagctcgtgtcgtgagatgttgggttaagtcccgcaacgagcgcaacccttgtttctagttaccatcattgagttggggactctagaaagactgccggtgataaaccggaggaaggtggggatgacgtcaaatcatcatgccccttatgacctgggctacacacgtactacaatggcgcatacaacaagaggcaaaagtgcaaactggagcgaatcttaaaaagtgcgtctcagttcggattgaagtctgcaactcgacttcatgaagttggaatcgctagtaatcgcggatcagcatgccgcggtgaatacgttctcgggccttgtacacaccgcccgtcaaaccatgagagttggtaatacccgaagccggtgggctaaccgcaaggaggcagccgtcgaaggtaggactgatgattggggttaagtcgtaacaaggtatccctacgggaacgtggggatggatcacctcctttct

SEQ ID NO: 3697 - DNA, 1534 bp, Erysipelotrichaceae bacterium SG0102
  ref <308>: DATABASE ACCESSION NUMBER: NCBI ACCESSION: NZ_AP019309.1
  ref <309>: DATABASE ENTRY DATE: 2019-04-01
  ref <313>: RELEVANT RESIDUES IN SEQ ID NO: (1)..(1534)
aatggagagtttgatcctggctcaggatgaacgctggcggcgtgcctaatacatgcaagtcgaacggagcaccttggtgctcagtggcgaacgggtgaggagaacataggtaacctgcccctccgagggggacaacagctggaaacggctgctaagaccgcatagacgcattcagggcatcctggatgcgctaaatgaccggatggtcagcgggggggatggacctatgcagtattagctagttggcggggcaacggcccaccaaggcgacgatacttagccggcctgagagggcggacggccacactgggactgagacacggcccagactcctacgggaggcagcagtagggaattttcggcaatgggggaaaccctgaccgagcaacgccgcgtgaacgaagaaggccttcgggtcgtaaagttctgttgtacgggaagaacgtcggatggaggaaatgccatgcgagtgacggtaccgaacatagaaagccacggctaactacgtgccagcagccgcggtaatacgtaggtggcgagcgttatccggaatcattgggcgtaaagagggagcaggcggtgatacaggtctggaggtgaaagcccgaagctaaacttcgggaagccccggaaaccggatcactggagtgcggaagaggatcgtggaattccatgtgtagcggtgaaatgcgtagatatatggaggaacaccagtggcgaaggcgacggtctggtccgcaactgacgctcagtcccgaaagcgtggggagcaaataggattagataccctagtagtccacgccgtaaacgatcgatactaagtgtcgggagtcagatcccggtgctgcagtcaacgcaataagtatcgcgcctgagtagtacgttcgcaagaatgaaactcaaaggaattgacgggggcccgcacaagcggtggagcatgtggtttaattcgaagcaacgcgaagaaccttaccaggtcttgacatcgatctaaaagggagagagatctcctcatagctatagagaagacaggtggtgcatggttgtcgtcagctcgtgtcgtgagatgttgggttaagtcccgcaacgagcgcaacccctgtcgccagttgccagcattgagttggggactctggcgagactgcctctgcaaggaggaggaaggcggggatgacgtcaaatcatcatgccccttatgacctgggccacacacgtgctacaatggacggagcagagggaagcgagaccgcgaggttgagcagagcccagaaacccgttctcagttcggactgcagtctgcaactcgactgcacgaagctggaatcgctagtaatcgcggatcagcatgccgcggtgaatacgttctcgggccttgtacacaccgcccgtcacaccatgagagtcagcaacacccgaagccggtggctcaaccgcaaggagagagctgtctaaggtggggccgatgattggggtgaagtcgtaacaaggtatccctacgggaacgtggggatggatcacctcctttctagggaga

SEQ ID NO: 3698 - DNA, 1493 bp, Erythrobacter aquimixticola
  ref <308>: DATABASE ACCESSION NUMBER: NCBI ACCESSION: NZ_RAHX01000001.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgccctcttcggagggagtggcgcacgggtgcgtaacgcgtgggaacctgcccttaggttcggaataacagtgagaaatcgctgctaataccggataatgtcttcggaccaaagatttatcgcctttggatgggcccgcgttggattagctagttggtagggtaaaggcctaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgcacgtaggcggcgtcgcaagtcaggggtgaaatcccggggctcaaccccggaactgcccttgaaactgcaatgctagaatattggagaggcaagtggaattccgagtgtagaggtgaaattcgtagatattcggaagaacaccagtggcgaaggcgacttgctggacaattattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatccttcgacggttaccagagatggtttcctcccttcggggcgaagtgacaggtgctgcatggctgtcgtcagctcgtgtcgtgagatgttgggttaagtcccgcaacgagcgcaaccctcatccttagttgccatcatttagttgggaactctaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaaggtggtgcgctaaccggtttaccggaggcagccaaccacggtgggatcagcgactggggtgaagtcgtaacaaggtagccgtaggggaacctgcggctggatcacctcctttctaag

SEQ ID NO: 3699 - DNA, 1495 bp, Erythrobacter atlanticus
  ref <308>: DATABASE ACCESSION NUMBER: NCBI ACCESSION: NZ_CP011310.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaacccttcggggtgagtggcgcacgggtgcgtaacgcgtgggaacctgcccttaggttcggaataacagcgagaaattgctgctaataccggataatgtcttcggaccaaagatttatcgcctttggatgggcccgcgttggattagctagttggtgaggtaaaggctcaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgaacgtaggcggtctagtaagtcaggggtgaaatcccggagctcaactccggaactgcccttgaaactactaaactagaatcctggagaggtcagtggaattccgagtgtagaggtgaaattcgtagatattcggaagaacaccagtggcgaaggcgactgactggacaggtattgacgctgaggttcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatccttcgacggttacgagagatcgtttccttccttcgggacgaagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaaggtggtgcgctaaccggtttaccggaggcagccaaccacggtgggatcagcgactggggtgaagtcgtaacaaggtagccgtaggggaacctgcggctggatcacctcctttctaagga

SEQ ID NO: 3700 - DNA, 1495 bp, Erythrobacter gangjinensis
  ref <308>: DATABASE ACCESSION NUMBER: NCBI ACCESSION: NZ_CP018097.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaacccttcggggtgagtggcgcacgggtgcgtaacgcgtgggaacctgcccttaggttcggaataacagtgagaaatcgctgctaataccggataatgtcttcggaccaaagatttatcgccaaaggatgggcccgcgttagattagatagttggtggggtaacggcctaccaagtcgacgatctatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgcacgtaggcggtgtcgcaagtcaggggtgaaatcccggggctcaaccccggaactgcccttgaaactgcaacactagaatactggagaggcaagtggaattccgagtgtagaggtgaaattcgtagatattcggaagaacaccagtggcgaaggcgacttgctggacagtgattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatccttcgacggttaccagagatggtttccttccttcgggacgaagtgacaggtgctgcatggctgtcgtcagctcgtgtcgtgagatgttgggttaagtcccgcaacgagcgcaaccctcatccttagttgccatcatttagttgggaactctaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaaggtggtgcgctaaccggtttaccggaggcagccaaccacggtgggatcagcgactggggtgaagtcgtaacaaggtagccgtaggggaacctgcggctggatcacctcctttctaagga

SEQ ID NO: 3701 - DNA, 1493 bp, Erythrobacter litoralis
  ref <308>: DATABASE ACCESSION NUMBER: NCBI ACCESSION: NZ_CP017057.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggggaaaccctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcgcgtaggcggctatttaagtcaggggtgaaatcccggggctcaaccccggaactgcccttgaaactggatggctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagactccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagctatcccgcaagggtgagctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcaactcctttctaagga

SEQ ID NO: 3702 - DNA, 1494 bp, Erythrobacter longus
  ref <308>: DATABASE ACCESSION NUMBER: NCBI ACCESSION: NZ_JMIW01000006.1
  ref <309>: DATABASE ENTRY DATE: 2019-04-01
  ref <313>: RELEVANT RESIDUES IN SEQ ID NO: (1)..(1494)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttactagggatgataatgacagtacctagagaataagctccggctaactccgtgccagcagccgcggtaatacggagggagctagcgttgttcggaattactgggcgtaaagcgcgcgtaggcggttatccaagtcaggggtgaaatcccggagctcaactccggaactgcccttgaaactaggtaactagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatagagcctgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagactccttcccttcggggacctagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggtatctacagtgagcagcgatcccgcaagggtcagctaatctccaaaagatatctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaagatagtgcgctaaccttttaggaggcagctagccacggtgggatcagcgactggggtgaagtcgtaacaaggtagccgtaggggaacctgcggctggatcacctcctttctaagga

SEQ ID NO: 3703 - DNA, 1495 bp, Erythrobacter luteus
  ref <308>: DATABASE ACCESSION NUMBER: NCBI ACCESSION: NZ_LBHB01000002.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaacccttcggggtgagtggcgcacgggtgcgtaacgcgtgggaacctgcccttaggttcggaataacagttagaaatgactgctaataccggataatgtcttcggaccaaagatttatcgcctttggatgggcccgcgtaggattagctagttggtgaggtaaaggctcaccaaggcgacgatccttagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgaacgtaggcggcgcagcaagtcaggggtgaaatcccggagctcaactccggaactgcccttgaaactgcagtgctagaatcctggagaggcgagtggaattccgagtgtagaggtgaaattcgtagatattcggaagaacaccagtggcgaaggcgactcgctggacaggtattgacgctgaggttcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatccttcgacggttaccagagatggtttccttccttcgggacgaagtgacaggtgctgcatggctgtcgtcagctcgtgtcgtgagatgttgggttaagtcccgcaacgagcgcaaccctcatccttagttgccatcattcagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaagatggtgcgctaacctgcttgcaggaggcagccagccacggtgggatcagcgactggggtgaagtcgtaacaaggtagccgtaggggaacctgcggctggatcacctcctttctaagga

SEQ ID NO: 3704 - DNA, 1495 bp, Erythrobacter marinus
  ref <308>: DATABASE ACCESSION NUMBER: NCBI ACCESSION: NZ_LDCP01000001.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaacccttcggggttagtggcgcacgggtgcgtaacgcgtgggaacctgcccttaggtttggaataacagcgagaaattgctgctaataccagataatgtctccggaccaaagatttatcgccaaaggatgggcccgcgttggattagctagttggtgaggtaaaggctcaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgaacgtaggcggtctattaagtcaggggtgaaatcccggagctcaactccggaactgcccttgaaactgctagactagaatcctggagaggtcagtggaattccgagtgtagaggtgaaattcgtagatattcggaagaacaccagtggcgaaggcgactgactggacaggtattgacgctgaggttcgaaagcgtggggagcaaacaggattagataccctggtagtccacgccgtaaacgatgataactagctgttcgggttcacagaacttgagtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatccttcgacggtttcgagagatcgattccttccttcgggacgaagtgacaggtgctgcatggctgtcgtcagctcgtgtcgtgagatgttgggttaagtcccgcaacgagcgcaaccctcatccttagttgccatcattcagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaaggtggtgcgctaaccggtttaccggaggcagccaaccacggtgggatcagcgactggggtgaagtcgtaacaaggtagccgtaggggaacctgcggctggatcacctcctttctaagga

SEQ ID NO: 3705 - DNA, 1491 bp, Erythrobacter odishensis
  ref <308>: DATABASE ACCESSION NUMBER: NCBI ACCESSION: NZ_QYOS01000024.1
  ref <309>: DATABASE ENTRY DATE: 2019-04-01
  ref <313>: RELEVANT RESIDUES IN SEQ ID NO: (1)..(1491)
caaacttgagagtttgatcctggctcagaacgaacgctggcggcatgcctaacacatgcaagtcgaacgaacccttcggggtgagtggcgcacgggtgcgtaacgcgtgggaacctgcccttaggtttggaataacgttccgaaaggaacgctaataccaaataatgtcttcggaccaaagatttatcgcctttggatgggcccgcgtaggattagctagttggtggggtaaaggctcaccaaggcgacgatccttagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgcacgtaggcggcttttcaagtcaggggtgaaatcccggggctcaaccccggaactgcccttgaaactggatcgctagaatattggagaggcaagtggaattccgagtgtagaggtgaaattcgtagatattcggaagaacaccagtggcgaaggcgacttgctggacaattattgacgctgaggtgcgaaagcgtggggagcaaacaggattagataccctggtagtccacgccgtaaacgatgataactagctgtccgggttcacagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatccttcgacggtttctggagacagattccttccttcgggacgaagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaaggtggtgcgctaaccggtttaccggaggcagccaaccacggtgggatcagcgactggggtgaagtcgtaacaaggtagccgtaggggaacctgcggctggatcacctcctttcta

SEQ ID NO: 3706 - DNA, 1495 bp, Erythrobacter seohaensis
  ref <308>: DATABASE ACCESSION NUMBER: NCBI ACCESSION: NZ_CP024920.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataacagttagaaatgactgctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctttttaagtcagaggtgaaatcccagggctcaaccctggaactgcctttgaaactggaaagctagaatattggagaggtaagtggaattccgagtgtagaggtgaaattcgtagatattcggaagaacaccagtggcgaaggcgacttactggacaattattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagattccttcccttcggggacctagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggtatctacagtgagcagcgatcccgcgagggttagctaatctccaaaagatatctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaacctgcttgcaggaggcagccaaccacggtgggttcagcgactggggtgaagtcgtaacaaggtagccgtaggggaacctgcggctggatcacctcctttctaag

SEQ ID NO: 3707 - DNA, 1494 bp, Erythrobacter sp. AP23
  ref <308>: DATABASE ACCESSION NUMBER: NCBI ACCESSION: NZ_LNBY01000017.1
  ref <309>: DATABASE ENTRY DATE: 2019-04-01
  ref <313>: RELEVANT RESIDUES IN SEQ ID NO: (1)..(1494)
caaacttgagagtttgatcctggctcagaacgaacgctggcggcatgcctaacacatgcaagtcgaacgaagccttcgggcttagtggcgcacgggtgcgtaacgcgtgggaacctgcctttaggttcggaataacagttagaaatgactgctaataccggataatgtcttcggaccaaagatttatcgcctttagatgggcccgcgttggattagatagttggtggggtaatggcctaccaagtcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagattccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcggtgcgctaaccttttaggaggcagccgaccacggtgggttcagcgactggggtgaagtcgtaacaaggtagccgtaggggaacctgcggctggatcacctcctttctaagga

SEQ ID NO: 3708 - DNA, 1492 bp, Erythrobacter sp. Alg231-14
  ref <308>: DATABASE ACCESSION NUMBER: NCBI ACCESSION: NZ_LT702999.1
  ref <309>: DATABASE ENTRY DATE: 2019-04-01
  ref <313>: RELEVANT RESIDUES IN SEQ ID NO: (1)..(1492)
caaacttgagagtttgatcctggctcagaacgaacgctggcggcatgcctaacacatgcaagtcgaacgaacccctcggggtgagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttactagggatgataatgacagtacctagagaataagctccggctaactccgtgccagcagccgcggtaatacggagggagctagcgttgttcggaattactgggcgtaaagagaacgtaggcggctatccaagtcaggggtgaaatcccggggctcaaccccggaactgcccttgaaactaggtagctagaattctggagaggttagtggaattccgagtgtagaggtgaaattcgtagatattcggaagaacaccagtggcgaaggcgactgactggacagatattgacgctgaggttcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgatttctggagacagatctcttcccttcggggacctagtgacaggtgctgcatggctgtcgtcagctcgtgtcgtgagatgttgggttaagtcccgcaacgagcgcaaccctcatccttagttgccatcatttagttgggcactttaaggaaactgccggtgataagccggaggaaggtggggatgacgtcaagtcctcatggcccttacaggctgggctacacacgtgctacaatggtatctacagtgagcagcgatcccgcgagggttagctaatctccaaaagatatctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaagatagtgcgctaaccttttaggaggcagctagccacggtgggatcagcgactggggtgaagtcgtaacaaggtagccgtaggggaacctgcggctggatcacctcctttctaag

SEQ ID NO: 3709 - DNA, 1491 bp, Erythrobacter sp. CCH5-A1
  ref <308>: DATABASE ACCESSION NUMBER: NCBI ACCESSION: NZ_LSKQ01000322.1
  ref <309>: DATABASE ENTRY DATE: 2019-04-01
  ref <313>: RELEVANT RESIDUES IN SEQ ID NO: (1)..(1491)
aacttgagagtttgatcctggctcagaacgaacgctggcggcatgcctaacacatgcaagtcgaacgagaccttcgggtctagtggcgcacgggtgcgtaacgcgtgggaacctgcccttaggttcggaataactcagagaaatttgagctaataccggataatgtcttcggaccaaagatttatcgcctttggatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgagatgataatgacagtatcgggagaataagctccggctaactccgtgccagcagccgcggtaatacggagggagctagcgttgttcggaattactgggcgtaaagcgcacgtaggcggctttttaagtcaggggtgaaatcccggggctcaaccccggaactgcccttgaaactgggaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacaggattagataccctggtagtccacgccgtaaacgatgataactagctgtccgggttcatggaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacgacttctggagacagatttcttcccttcggggacctagtgacaggtgctgcatggctgtcgtcagctcgtgtcgtgagatgttgggttaagtcccgcaacgagcgcaaccctcgtccttagttgccatcattaagttgggcactttaaggaaactgccggtgataagccggaggaaggtggggatgacgtcaagtcctcatggcccttacaggctgggctacacacgtgctacaatggcatctacagtgggcagctattccgcaaggatgcgctaatctccaaaagatgtctcagttcggattgtcctctgcaactcgagggcatgaaggcggaatcgctagtaatcgcggatcagcatgccgcggtgaatacgttcccaggccttgtacacaccgcccgtcacaccatgggagttggattcacccgaaggcagtgcgctaaccgcaaggaggcagctgaccacggtgggttcagcgactggggtgaagtcgtaacaaggtagccgtaggggaacctgcggctggatcacctcctttctaagga

SEQ ID NO: 3710 - DNA, 1489 bp, Erythrobacter sp. CFH 74456
  ref <308>: DATABASE ACCESSION NUMBER: NCBI ACCESSION: NZ_SDSI01000004.1
  ref <309>: DATABASE ENTRY DATE: 2019-04-01
  ref <313>: RELEVANT RESIDUES IN SEQ ID NO: (1)..(1489)
caaacttgagagtttgatcctggctcagaacgaacgctggcggcatgcctaacacatgcaagtcgaacgagaccttcgggtctagtggcgcacgggtgcgtaacgcgtgggaacctgcccttaggttcggaataacagttggaaacgactgctaataccggataatgtcttcggaccaaagatttatcgcctttggatgggcccgcgtaggattagctagttggtggggtaacggcctaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggcttatcaagtcaggggtgaaatcccggagctcaactccggaactgcccttgaaactggcaagctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggcacatggtgtttgggtggcgcagctaacgcattaagttatccgcctggggagtacggtcgcaagattaaaactcaaaggaattgacgggggcctgtacaagcggtggagcatgtggtttaattcgaagcaacgcgcagaaccttaccagcctttgacatcccgcgctatcctgagagatcaggagttcccttcggggacgcggtgacaggtgctgcatggctgtcgtcagctcgtgtcgtgagatgttgggttaagtcccgcaacgagcgcaaccctcgtccttagttgccatcattcagttgggcactttaaggaaactgccggtgataagccggaggaaggtggggatgacgtcaagtcctcatggcccttacaggctgggctacacacgtgctacaatggcgttgacagtgggcagctagaccgcgaggtcgtgctaatctctaaaagacgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaaggcgctgcgctaacccgcaagggaggcaggcgaccacggtgggatcagcgactggggtgaagtcgtaacaaggtagccgtaggggaacctgcggctggatcacctcctttcta

SEQ ID NO: 3711 - DNA, 1495 bp, Erythrobacter sp. EhN03
  ref <308>: DATABASE ACCESSION NUMBER: NCBI ACCESSION: NZ_LXYL01000010.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgccctcttttagagggagtggcgcacgggtgcgtaacgcgtgggaacctgcccttaggttcggaataactcagagaaatttgagctaataccggataatgtcttcggaccaaagatttatcgcctttggatgggcccgcgtaggattagatagttggtggggtaatggcctaccaagtcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgcttgggctcatggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagattccttcccttcggggacctagtgacaggtgctgcatggctgtcgtcagctcgtgtcgtgagatgttgggttaagtcccgcaacgagcgcaaccctcgtccttagttgccatcattcagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcggtgcgctaaccttttaggaggcagccgaccacggtgggttcagcgactggggtgaagtcgtaacaaggtagccgtaggggaacctgcggctggatcacctcctttctaagga

SEQ ID NO: 3712 - DNA, 1497 bp, Erythrobacter sp. HI0019
  ref <308>: DATABASE ACCESSION NUMBER: NCBI ACCESSION: NZ_LWEN01000696.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgaacccttcggggtgagtggcgcacgggtgcgtaacgcgtgggaacctgcctttaggttcggaataacagttagaaatgactgctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagattccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaaccagtttactggaggcagccaaccacggtgggttcagcgactggggtgaagtcgtaacaaggtagccgtaggggaacctgcggctggatcacctcctttctaagga

SEQ ID NO: 3713 - DNA, 1495 bp, Erythrobacter sp. HI0020; identical to SEQ ID NO: 3711
  ref <308>: DATABASE ACCESSION NUMBER: NCBI ACCESSION: NZ_LWEO01000142.1
  ref <309>: DATABASE ENTRY DATE: 2019-04-01
  ref <313>: RELEVANT RESIDUES IN SEQ ID NO: (1)..(1495)

SEQ ID NO: 3714 - DNA, 1497 bp, Erythrobacter sp. HI0028; identical to SEQ ID NO: 3712
  ref <308>: DATABASE ACCESSION NUMBER: NCBI ACCESSION: NZ_LWES01000435.1
  ref <309>: DATABASE ENTRY DATE: 2019-04-01
  ref <313>: RELEVANT RESIDUES IN SEQ ID NO: (1)..(1497)

SEQ ID NO: 3715 - DNA, 1063 bp, Erythrobacter sp. HI0063
  ref <308>: DATABASE ACCESSION NUMBER: NCBI ACCESSION: NZ_LWFF01000116.1
  ref <309>: DATABASE ENTRY DATE: 2019-04-01
  ref <313>: RELEVANT RESIDUES IN SEQ ID NO: (1)..(1063)
aatggcctaccaagtcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgcttgggctcatggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagattccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagctatcacgcgagtgtgagctaatctccaaaagatgtctcagttcggattgttctctgcaactcgagagcatgaaggcggaatcgctagta

SEQ ID NO: 3716 - DNA, 1497 bp, Erythrobacter sp. HI0074; identical to SEQ ID NO: 3712
  ref <308>: DATABASE ACCESSION NUMBER: NCBI ACCESSION: NZ_LWFO01000417.1
  ref <309>: DATABASE ENTRY DATE: 2019-04-01
  ref <313>: RELEVANT RESIDUES IN SEQ ID NO: (1)..(1497)

SEQ ID NO: 3717 - DNA, 1497 bp, Erythrobacter sp. HI0077; identical to SEQ ID NO: 3712
  ref <308>: DATABASE ACCESSION NUMBER: NCBI ACCESSION: NZ_LWFR01000366.1
  ref <309>: DATABASE ENTRY DATE: 2019-04-01
  ref <313>: RELEVANT RESIDUES IN SEQ ID NO: (1)..(1497)

SEQ ID NO: 3718 - DNA, 1495 bp, Erythrobacter sp. HI00D59
  ref <308>: DATABASE ACCESSION NUMBER: NCBI ACCESSION: NZ_LWEG01000091.1
  ref <309>: DATABASE ENTRY DATE: 2019-04-01
  ref <313>: RELEVANT RESIDUES IN SEQ ID NO: (1)..(1495)
caaacttgagagtttgatcctggctcagaacgaacgctggcggcatgcctaacacatgcaagtcgaacgccctcttttagagggagtggcgcacgggtgcgtaacgcgtgggaacctgcccttaggttcggaataactcagagaaatttgagctaataccggataatgtcttcggaccaaagatttatcgcctttggatgggcccgcgtaggattagatagttggtggggtaatggcctaccaagtcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcacgtaggcggcttttcaagtcaggggtgaaatcccggggctcaaccccggaactgcccttgaaactggatggctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgcttgggctcatggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctatgacatcctaggacggtttctggagacagattccttcccttcggggacctagtgacaggtgctgcatggctgtcgtcagctcgtgtcgtgagatgttgggttaagtcccgcaacgagcgcaaccctcgtccttagttgccatcattcagttgggcactttaaggaaactgccggtgataagccggaggaaggtggggatgacgtcaagtcctcatggcccttacaggctgggctacacacgtgctacaatggcatctacagtgagcagcgatcccgcgagggttagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcggtgcgctaaccttttaggaggcagccgaccacggtgggttcagcgactggggtgaagtcgtaacaaggtagccgtaggggaacctgcggctggatcacctcctttctaagga

SEQ ID NO: 3719 - DNA, 1497 bp, Erythrobacter sp. HKB08
  ref <308>: DATABASE ACCESSION NUMBER: NCBI ACCESSION: NZ_CP035310.1
  ref <309>: DATABASE ENTRY DATE: 2019-04-01
  ref <313>: RELEVANT RESIDUES IN SEQ ID NO: (1)..(1497)
caaacttgagagtttgatcctggctcagaacgaacgctggcggcatgcctaacacatgcaagtcgaacgatcacttcggtgatagtggcgcacgggtgcgtaacgcgtgggaacctgcctttaggttcggaataactcagagaaatttgagctaataccggataatgtcttcggaccaaagatttatcgcctttagatgggcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggcctaccaagtcaggggtgaaatcccggggctcaaccccggaactgcccttgaaactggtaagctagaatcctggagaggcgagtggaattccgagtgtagaggtgaaattcgtagatattcggaagaacaccagtggcgaaggcgactcgctggacaggtattgacgctgaggtgcgaaagcgtggggagcaaacaggattagataccctggtagtccacgccgtaaacgatgataactagctgtccgggttcatagaacttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctggtcgcggattagagagatcttttccttcagttcggctggaccagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcgttgacagtgggcagctagaccgcgaggtcgtgctaatctctaaaagacgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggtggtgcgctaacctgcttgcaggaggcagccaaccacggtgggttcagcgactggggtgaagtcgtaacaaggtagccgtaggggaacctgcggctggatcacctcctttctaag

SEQ ID NO: 3720 - DNA, 1493 bp, Erythrobacter sp. HN-E23
  ref <308>: DATABASE ACCESSION NUMBER: NCBI ACCESSION: NZ_RPFZ01000001.1
  ref <309>: DATABASE ENTRY DATE: 2019-04-01
  ref <313>: RELEVANT RESIDUES IN SEQ ID NO: (1)..(1493)
caaacttgagagtttgatcctggctcagaacgaacgctggcggcatgcctaacacatgcaagtcgaacgcccacttcggtgggagtggcgcacgggtgcgtaacgcgtgggaacctgcccttaggttcggaataacagttggaaacgactgctaatgccgaataatgtcttcggaccaaagatttatcgcctttggatgggcccgcgttggattagctagttggtggggtaaaggcctaccaaggcgacgatccatagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaaatactgggcgtaaagcgaacgtaggcggcttttcaagtcaggggtgaaatcccggggctcaaccccggaactgcccttgaaactggatggctagaatcctggagaggtcagtggaattccgagtgtagaggtgaaattcgtagatattcggaagaacaccagtggcgaaggcgactgactggacaggtattgacgctgaggttcgaaagcgtggggagcaaacaggattagataccctggtagtccacgccgtaaacgatgataactagctgtccgggctcttggagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctctgacggttaccagagatggtttcctcccttcggggcagagtgacaggtgctgcatggctgtcgtcagctcgtgtcgtgagatgttgggttaagtcccgcaacgagcgcaaccctcatccttagttgccatcatttagttgggaactctaaggaaactgccggtgataagccggaggaaggtggggatgacgtcaagtcctcatggcccttacaggctgggctacacacgtgctacaatggcatctacagtgggcagctatcacgcaagtgtgagctaatctccaaaagatgtctcagttcggattgttctctgcaactcgagagcatgaaggcggaatcgctagtaatcgcggatcagcatgccgcggtgaatacgttcccaggccttgtacacaccgcccgtcacgccatgggagttggtttcacccgaaggtggtgcgctaaccggttttccggaggcagccaaccacggtgggatcagcgactggggtgaagtcgtaacaaggtagccgtaggggaacctgcggctggatcacctcctttctaag

SEQ ID NO: 3721 - DNA, 1492 bp, Erythrobacter sp. KY5
  ref <308>: DATABASE ACCESSION NUMBER: NCBI ACCESSION: NZ_CP021912.1
  ref <309>: DATABASE ENTRY DATE: 2019-04-01
  ref <313>: RELEVANT RESIDUES IN SEQ ID NO: (1)..(1492)
caaacttgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgcgggaaaccgtgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctatccaagtcaggggtgaaatcccggggctcaaccccggaactgcccttgaaactaggtagctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagactccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagcgaactcgcaagggtgagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaagatagtgcgctaaccttttaggaggcagctagccacggtgggatcagcgactggggtgaagtcgtaacaaggtagccgtaggggaacctgcggctggatcacctcctttctaag

SEQ ID NO: 3722 - DNA, 1494 bp, Erythrobacter sp. NAP1
  ref <308>: DATABASE ACCESSION NUMBER: NCBI ACCESSION: NZ_CH672390.1
  ref <309>: DATABASE ENTRY DATE: 2019-04-01
  ref <313>: RELEVANT RESIDUES IN SEQ ID NO: (1)..(1494)
caaacatgagagtttgatcctggctcagaacgaacgctggcggcatgcctaacacatgcaagtcgaacgaacccttcggggttagtggcgcacgggtgcgtaacgcgtgggaacctgcctttaggttcggaataactcagagaaatttgagctaataccggataatgtcttcggaccaaagatttatcgcctttagatgggcccgcgttagattagatagttggtggggtaatggcctaccaagtcgacgatctatagctggtctgagaggatgatcagccacactgggactgagacacggcccagactcctacgggaggcagcagtggggaatattggacaatgcgggaaaccgtgatccagcaatgccgcgtgagtgatgaaggccttagggttgtaaagctcttttaccagggatgataatgacagtacctggagaataagctccggctaactccgtgccagcagccgcggtaatacggagggagctagcgttgttcggaattactgggcgtaaagcgcgcgtaggcggctatccaagtcaggggtgaaatcccggggctcaaccccggaactgcccttgaaactaggtagctagaatactggagaggtgagtggaattccgagtgtagaggtgaaattcgtagatattcggaagaacaccagtggcgaaggcgactcactggacagttattgacgctgaggtgcgaaagcgtggggagcaaacaggattagataccctggtagtccacgccgtaaacgatgataactagctgtccgggctcatagagcttgggtggcgcagctaacgcattaagttatccgcctggggagtacggtcgcaagattaaaactcaaaggaattgacgggggcctgcacaagcggtggagcatgtggtttaattcgaagcaacgcgcagaaccttaccagcctttgacatcctaggacggtttctggagacagattccttcccttcggggacctagtgacaggtgctgcatggctgtcgtcagctcgtgtcgtgagatgttgggttaagtcccgcaacgagcgcaaccctcgtccttagttgccatcatttagttgggcactttaaggaaactgccggtgataagccggaggaaggtggggatgacgtcaagtcctcatggcccttacaggctgggctacacacgtgctacaatggcatctacagtgggcagctatcacgcgagtgtgagctaatctccaaaagatgtctcagttcggattgttctctgcaactcgagagcatgaaggcggaatcgctagtaatcgcggatcagcatgccgcggtgaatacgttcccaggccttgtacacaccgcccgtcacaccatgggagttggtttcacccgaagatagtgcgctaaccttttaggaggcagctagccacggtgggatcagcgactggggtgaagtcgtaacaaggtagccgtaggggaacctgcggctggatcacctcctttctaagga
